United States Patent 10,724,096 (METHODS AND COMPOSITIONS FOR INHIBITING AND TREATING NEUROLOGICAL CONDITIONS) - sequence listing, part 49

SEQ ID NO: 1050 - DNA, 301839 bp, Homo sapiens
  mutation (227427)..(227427): g.227427T>C
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgcagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1051 - DNA, 301839 bp, Homo sapiens
  mutation (227475)..(227475): g.227475A>C
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagactattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1052 - DNA, 301839 bp, Homo sapiens
  mutation (266322)..(266322): g.266322C>T
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtctacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1053 - DNA, 301839 bp, Homo sapiens
  mutation (266337)..(266337): g.266337G>A
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcatttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1054 - DNA, 301839 bp, Homo sapiens
  mutation (286069)..(286069): g.286069A>T
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttctgtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1055 - DNA, 301839 bp, Homo sapiens
  mutation (289708)..(289708): g.289708T>C
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttccaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1056 - DNA, 301839 bp, Homo sapiens
  mutation (289722)..(289722): g.289722T>C
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgccgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1057 - DNA, 301839 bp, Homo sapiens
  mutation (289866)..(289866): g.289866T>G
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtactttggaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1058 - DNA, 363933 bp, Homo sapiens
tatgtcttcctaccattatactgtctctgcccaatattacttattctcttgcagtcgacatattaatataaaaaattaaagccaaagtacttaatcttataaaatacatcacaagcatcaggagtggcacaatcataacgccaaaggtggtagaggcagaagaaattactatggggtcagaagagactgagtaatgatggatttagagtacagaaaagggcaagttaggtaaggccatgatctaagaaaaatataaatagggctatactggaaaaatacaaatagaggtatactgggagtagcgggagaaaaggtgagacagttgagctggagccagattataaaccgtgataccagccttagaagcctgggcttcattctggttaacagtggttctgggattccagtgtacacaagaatcatcttggggagagactggtgactagacagattttaactcctgagattctaatttagtatgtttgggatggtcccagaaaactgcatcttaacaggtgattccagtacaaagacacactttgagacactccaccataggacaaatgattaagaaactctactattaactattgcaaatatgccaattccccatatgctgtgaaaatattcaattgcatccaatttttctttgttatttggcactgactttgtcactgtttacatcttgagtgaatttgtttaacaatgcgcttttcggggtaatatccacgatctacaaagaacttaaacaaatttacaagaaaaaatcaaacaaccccatcaaaaagtaggtgaaaaaagtaggatatgaacagacatttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcaattcctcaaggatctagaactagaaataccatttgacccagccatcccattactgggtatatacccaaaggattataaatcatgttgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaaggatgagttcgtgtcctttgtagggacatggatgaagctggaaaccatcattctcagcaaactattgcaaggacagaaaaccaaacaccgcatgttctcactcataggtgggaactgaacaatgagaacacttggacacagggtggggaacatcacacaccaggggctgtcgtggggtcgggggaggggtgagggatagcattaggagatatacctaatgtaaatgacgagttaatgggtgcagcacaccaatatggcacatgtatacatatgtaacaaacctgcatcttgtgcacatgtaccctagaacttaaagtgtaataaaaaaattacaaacaaacaaaaaaaaccaatgcgcttttctggttctctgactctctgaaatctctatcgtctcctctggcctctcatactttgccgtttctttacatgttatttcttaagattctgattttagtcctctacagatctccttgagtgatttcattcactcctaaggcgtatagagaatgctgatgccaacctcagaagattagactttgtcctgtcgataaagaggagttatagaagtttctaagaagtagaatatcatagagaaagacatgttctgggaatataaccttggagatggtctgcagaaaaggaatggggataggagaaacaggaggtagggagaatagttatgaaactatcaaaataactgtttaaagtcatcaccaagggatgacttcaaaacgaaaatgttacttttctagtagttcttccctttaagaaactagtcttatttcaataaattaataggcaagacccttctaaggacattggaatttcattatcttttttttttgctatacatttaactataatataacaaattaggtcctctgcaatgttaatcacagatagtaaaaatctgacatgacattgttctattataacatcaatgtgagttcttttctaaaacaagtggcatgaaggattttatagtattgatattgatatctgataaatttagttctttcattatggagtcaagaaatcatcactagtacagatactattcagaaataaatggtataccttcttttatgacttgaactcatgaaagaatggtaaaagtatgtttgattttactttatatgaaagtactcaagctattacaaccatatccattgtgtcttatacacaatggaaaatatagtattttctataattgaatccagaggtttctaaattggcagataaaatagtacctgtatttagatattctatttgaaacatgctttaatcttaggaaaacagaggcagaaagcacctaaattaggtgcaatcctgtctgctcctaatttagaaaataaaccaatttattggctattctttctcaagtgatccacattgagagatgctaggtctttatcaagatcaatttcaaaattttttttttttttgagacggagtcttgctctctcgcccaggctggagtgcagtggcgcgatctcagctcactgcaacctctgcctcctgggttcaagtgattctcctgcctcagtctcccaggtagctgggactacaggcgcccgccaccacacctggctaattttttgtatttttagtagagatggggtttcaccatgttagccaggatggtctcgatctcctgacctcgtgatccacccgcctcggcctcccgaagtgctgggattacaggcgtgagccaccgcgcccaggccaatttcaatttttaacaactgtcactacaagaaagtcaagaaaatagaaattagtcctccctcttgtgtgaccttggggaaattccttaagcattgtcttactttccacagcgctatcctcatcatacatatactgtgaagataaaatatctgttgaagattctttgagcaccttgggccagaagagctacagaaagccaaggtatagttattttcatatccacgacttcatttgccttttcccttgttgtagcctctctggaaattaagcaaagatgcctatcaccttctgcttaataacccttcatgtacttgaaattgttattctccccaggtacctcaagcacattttttaaagaggattgcctaaactctaaaacagcaatcaagggctatgagtcagcatttcacctagacataaaatcaaaatggtttaaaataggtaacattatctttttgaaatatgtacatacctctttggagaaactttgagacaactggagtttgcaagtttatgaatagtttattacatttcagtaagtgtattgtgaatcaataaagcaaaagttaaggacaatgagctcattaccaagccagttattgattctctggttccaaaatagaacagtacaggaagggtatagagaaaataggatttttcatgataaaaattttaagcatcttaggaacacagacctaaagaaactataagacacaacggaaatttcagcagctacttaggatgtttatttatttacctttttttgccaattagaattagttatttggtttttactcttaaaaaaaaaaagtattttcaactcaagtcagaggagtttgccaaaactgaatattacctcttactgacttaattattctttcaatttcttgtatatcttcctctcttgcctttgaaaagtttaccttactagctgtctatcttatatcactgtcgtagctcagactgccctaacaaaataccataggactgggtggtttaaacaccagaaatttatttcctcacagttctggtgattagaagttcaaactcaaggtgtcagcatggtctgtttctggagactactttctttctggcttatatgttccaggatgggatggttggaggagccccatctccagataccatcacattaataagggcttcaacatataaattttggggacgggaacatctagtccaaaacattcactaacagaaaaattgacactggctccatatcatcaagcagataatatggaaatgaacaagtcaatttgttttcaaactattcttatgggaagcttccctttttctcccttttacagcaatctaattcaatggaaaaggaacttcttaaacaatttatgaactaacactaatttcatgaaccagttctttaaaaagcgaagacaaaaagtgagacacatgattttggtaaaaactgaaaaatagaccattaacccatttatatagtatgtttaataaaaacaacttttaaacccttatactttgttcttatatcaagtaaagattcttaaagtaatgtaaaacatttgaatgtccctggaaagtaatataacacacaataacccttctatattacatatatatctatatgtatatgtatatgttagagactgggtcttgctattctgcccaggctggtcgcaaactcctgggctcaagtgatcctcccacctcggcctcccaaagtgctgggattataggcatgagccaccacatttggccctatattacattttcatgcatattattaaaagaaatggtgacttacatatggaaatacagaaaactgaaatagtaaacaaaattaacaaagttataattgggttgtgctgaagtttacctaattttaatacaaatagttatttttattacatgctacacaaatttgatggtataagaaatgtgtttttcttgtttgcatgaatttcttcattgcaaaatacttaaaatgtacataatttttaaaaaacaactaagaggccgggcacggtggctcatgcctgtagtcccagcactttgggaggccgaggtgggcggatcacgaggtcaggagatcgagaccatcctggccagcacggtgaaaccccatctctactaaaaatacaaaaaaattagctgggcatggtggcatgcgcctgtaatcccagctacttgggaggctgaggcaggagaatcgcttgaatccaggaggtggaggttgcagtgagccgagattgcgccactgcactccagtctggcgacagagcaagactccatctcaaaaaaaaaacaaaaacaaaaaaacaattaagaacatttccttaatgactatgaagtgaatagacagcatatttcaaattttcaagtagaagggtagaggaatgtaggacaaaaggtgactgagatccagagtttaggtgacttggcaaagtcatccaattagcaggtgcagagttatatatgaaacccaagattttcctgtctaaaaatgctgaagattagtatattcaagattaaggggaagaaaatctaattatactttagatcatttcataccagaaaacagctatagaaactagtttttcattttcaaaactcaattaagtgtgtgaatggtccgttggtgtccagctttaacacctgcctgttcccataagtgccatgttccactacaaccctagcttcagcacacttgctattagcagctacttctttttcacatagagtcacaaattgagagtaaagttcaaacccttcttcttttccagagttagagtgatattgcatgtttcttccttttagtcttcctccaagggtagcttgagggataataagaatgttgccaggtagatccaatatagagacatgcttgccattttctgtctcacttaatttcacatttaacagtgtattaactgggtgaggaagaaaggcaaaacattttaaagtgaaaaacaaacatgaagaaaaccatcaagtttttagtcagcaaatctcatgtttaaaattcagtttgtcagctcatgcctctaacccaaagtctctatttagatttaaaatactgcttcactaagctaaataatctaagcatgaaaaataaggcaattttcatgcagaaaatggcatgatattttaaatctgaattggcagttaagataacctaacaataagttcatccagaaaggtctaaagaattaactgtacactggaacctcaaatattgttcccctgggggaatacatgagaagattttaccttcctgttctttttatttagtaagtaaatcccactggaaaaatatgaggataactcctcctcacaccaaattctgcttgcttgcttgcttgctttatttatttatgtatttatttagagacagagtctcactctgtcgcccaggctggagtgcaatggcgtgatctctgctcactgcaacctctgcctcctgggttcaagcgattctcctgcctcagcctcccaagtagctgggactacaggtgcgtgccaccacacccggctaattttttgtatttttagtagagatggggtttcaccatgctagccagggtggtctcgatctcctgacctcgtgatccactcgccttggcctcccaaagcgttgggattacaggcgtgagccaccacgcccagctaaattcttctttataatggaatatcaaataacaattttagcgcagttattattttaaacttagttgccaagagttttaagcagagacaaaggttcctgtttcaatcccaatataaaccagctaattttgttgtttaataaccttaaaggcaatatgaacatggactaatcattgtataaatattactcatgagagaagggtaaaggtgaaagcaagaatcatcagaaattcattgttacaactgaaaaagtaaataaaaagatataaagctatggcattatcttcatacacatatacgaaaacgtgatattatttttgtagcattcgtgagatttcctatagctaataagaagtgtcgaaaccaccataaatatccatatatagctaaaagcctaaacttagaaagcctttatacctcaacattaaccatttttgaaacaataagcaaaagaagtgtctaatataaatagacctagggtctccctacctctataaaggtatacatgacttctgtttgcaaagaatagtcctgagagggcaaatggtagaaggaactacataaacttcaagacacctgccctcaaattaggcattaaaaggcatgctttctgttggggtagctaacggttttaattattagagggtctgtagtaagtattcatatggttacccctctctacaaatcatggaattaatctggtaaaaacctgccaaggcgaacacccaaatgaattcctaagctaggcattaagcatcatcaattttcacttaactaacatttatttttaaatacctctagttttctctattacaaataggactttgctgtttagccagcagtctttattgactgcttgtaaggaaactttccagggcacttcattccactcgaaatcactatctagctatctaggcctccagctagtgacagagtaaataggcaattttggaataacaggcctgagaggtaatgctacaatttattatgtttccacatacctccctctactggctataattgagatttcagttaatgctgttggcatacaaatatcagtatgtagataaatacaatgtagaaacagtaagtagaattaaaacgagacaatgaattaatggcatgctggaaactcaaatatcctaaaacaggttatcaatcaagtatctctaatgatgtataggagatgttaagctttgacaggtttcttgccctctctgtccaattatactgaaggtgaattgaggaagattctacacatctctatgttaaccatgctatttcagattttgcagatttaactggttattatattctcaagtgatatatgctttgattggaaatatctgaatctatgtaataaatatgaggtgaggcttaagagaatcccaccacattgacttacttagcctgctggaatagagggaagtacaagctaatactattaataatagatggacttactttgcttacaactcaaacgagtagaatatgattcttagagtcatatatttctttactgaaaatcatgatataaaaaatcatgtgttagatagtgtcagaccatccacaagagtcagggtggacctcctcagtgttttaaattcactacaatcttatgcatgtatttaaagtgaactcacaaagacagatatggaagcacacaggatttaatcactataaaataacatgtggtttggatatgataggcatatttcatcctattatgatgaagaaccatttgagaattcataagacaactttatgaagtcaatcttaagtcagaatgacaaatactttcttcctgtttttgaagatttctacattttttatggaccaaaaaagatttaatccaaggcaaaatattaatttaggaaagtggacagaatgtgtaacactccagcattaggatctgacaattattctctgtaataggagtcctcattacattatgttcttttttttttttttttttgagatggagtctccctctgtcgcccaggctggagtgcagtggcgtgatctcggctcactgcaaactccacctcctgggctcatgccattctcctgcctcagcctcccgagtagctgggactacaggcgcccaccaccacacccggctaatttttttgtatttttagtagagacggggtttcaccatgttagccaggatggtcttgatctcctgacctcgtgatctgcccacctaggcctctcaaagtgctgggattacaggcgtgagccaccgcgcctggcctctctctctctctctttttttttctttcttcttcagaccagaacattatgctcttaacccatcagaggttccttattatcttctggattcaaatttcaaactattgcagttactggctttccattctcacctagcatagtctcttaagtctggttttcatcttttgacaaagttgtcagacatgtttgatatgtcagtataaaattccctctaggagttttagctttttgtctaagctcttcctcattggcctatttgcccttgaagctcttctaggttttctgtaagcttcaactgcccatttgtataattaatatttcttattaatccaacttattaatggatgctgtcctttactaatgaggagaatacaacctgttcccaaccttaaggatagcttttctttcaagtttgtatgtatgtttgtttgtggatataatctttatatccaaatactgtcctgagagggtatgatttgatttggtatatctgaacctatgtaattatcacatgaattgctatagctatgtgagatagtgtatatatacatatcactatacagtgctatagcccgtccaggaaaccagaaagctgcaggtaggtaaattactattcagagatccctaacattgactctgttttccatgtccttggaggaggtgtggctgtgatgacactgaattcagctcaagacccaggagaaccttacatctattcttatttccacaaggaagtgcacacatggctaatgcaaattcttccataataatgatataaacttgagttgtccaggtttgatgagacccacatcttgtatatacagtgtcatctactgcctctgttaggggctctaggggataaaggaaactatattaagaaatgcagcatctgtttctccctgtgtgaccaccctacttccaagaagtttctgtatccttggctgaagtgcactgtgtgtatgtgtatgtgtgtacactcttctacatcaatctgtaagtcactgaaatgctgcagatgttttaaaaaaattccaccatacttgcttactttaaactttgaaacaggcaaatagctaaggccaataacactagatagaattaagtaattaataatttaacagcacaatttaacattgtgcttcttaggatgggcagggattggttaatggatacaaaattatagctagataggaggaatgagttctggtgttctggagcactgtaggatgaatatggctaactataatttattgtatactgtcaaaagtctagaagaaaggattttaaatgttcacaacacaaataataaatttttgagataatgcatatctggtttgattgttatacattgtatacagtattaaaatatcactatgtatcccatgaatatgtaaaattattatttattattttaaaaataaaaggggaggaaagagattgtgctttttgtcccttcgggttcatttgtctattactattctttctcactctctttttttttttttttttgagacagggtctcactctgttgcccaggctggagtgcagtggcaccatctcggctcactgcagcctcgacctcctggcctcaagtaatcttccagcctcagcctcctaagtagctaggaccataggcacaggtcaccgtacccagctacttttgtttattttttgtagagaagaggtcttactatgttgcccaggctggcttctaactcctgggttcaagtaatccacttgccttggcctcccaacgtgttgggattacaggtgtgagcaccatgcttggcctctcactcttaaaaaagaaacaaagtcaaacacatacccattttgggaagaagttctttatcagctcccttgaaaaagcacacgtagatcaccagtcctctttggacctatgagaaatcaccacagtaaactcagattacaacaatatctgtaaagatacagggctaaatgggtacagtttcacaactattaatattatagacatagaggttaaaagcacagaaaatgaactttacaaaagatttctcatgtgagaaaacaaaatatttttcaattttcaatcatctcagttatttctttcaaatttaagtttaaaatatacccaagagcagtgaagacaagttataccttcaaacatttatttctaatcaaaatcattaagaggatcaaccagccttttctcaagtaagggtgacagacttagaaacatttcgtttgctgggccccatttattcaatgccaagtgaattcacattataccagatacagctgatggataaacaacatgtgactgatatcttttgacatcatctctctttatttcccctaatccatttacttacaaataatgaaaataagggtctgattctatttctataagctccaggaaactgtccaattatttgttgttgttgttgttattgttgttaatgctttatataaacatgattaggacttgaaaactgcatttgtgatagtaaattctacattaaaaggttggttgttatcaggaatataggcttatttattttacataatggcttggatatttcttagatcttgtaggacagagactatacagaaaagagacatttgaatagtgactttgattctgcttctgagtgaatcattagatttttttgattctgtaaattaatcttgactccaggagctattaggaagattaaatgagttaacatttgtaaagtacttaaacacagtgcctggttcatagtaagtgctatattagtgtttattaaatgagtatgtaaaaataaatttaagggcagaggcacaatttatttcacattttaacttccaaagcactttacaggctgttttgtacacgatagggattcagtttatctgttgattgcattaacattcaactatatgttccaggctctatgcgttatccaaagaattttctagataaatgtaaatgcagctctgcactcacacgtgatttacctggaaaagaagtgagttttaaaaagtacaatcgtgctactgaaacaataggcaagggcctccaatgcatacccacgagaagctggcaagttattataggtatttgcactactgtcacaggcctctccactagtattgttttcatcatgaatcgaaatcttaagcatatttatatttggacacatgcaatgtcagaaataaatacctaatcatttgcagaacgatacctgttctttccactaacattatctcctcattaaggtctttgcctttcatttattccataatagatgttaagctgtgacttcaagtcaaaaatcactttccttataacttctttggtataaaacatttcaaatatatagaaaaatacagataattctcactgtagctttaaaaagttcacttaccaggaacaaaaacattagtctgtgacagcaaagttctaaatgaatgaaactaagaacaagcaaagaaagtaaccttcaaatcttgacaattaaaatgctgtttctaaaaaaacaagaacttttaataatagaacagggtagagaatatgtaagaagaaagaatttacattttctcaccatctaaattacttgtcagctctttaaactaatttagttatgtgtgtaggagtgaaagggaaagcctttaaaatagtttttaagtttataaacacaaactgatagtttggatgccagcaataaaatacatgtgattttgcataaggagatgtagcctgaacaacataaaaaagataaataagcatggaaggaaactaaatgactgatagtttgcaattatagtgtctggatgcaactataaaaatggataattcggccgggcacggtggctcaagcctgcaataccagcactttgggaggccgaggtgggcggaccacaaggtcaggagatcgagaccatcctggctagcacggtgaaactccgtctctagtaaaaatacaacaaattagccaggcgtggtggtgggcgcctgtggtcccagctgcttgggaggctgaggcaggagaatggcgtgaacccgggaggcggaggttgcagtgagccgagattgcgccattgcactccagcctgggtgacagagtgagactctgtctcaaaaaaaaaaaaaaaaaaaggataattattttatttattatttatttttgagatgaggtttcactctgtggctcaggctggagtgcagtggcgtgatcttggctcactacaacctctgcctcccggattcaagagattctcctgcctcagcctcccgagtagctgggattacaggtgcccgccaccaagcccggctaatttttgtatttttagtagagacgggatttcaacatgttggccaggctggtctcaaactcctgacctcaagtgatccgccggccttggcctcccaaagtgctgggattaccgcgcctggcaggttaattctttagataggatggcaaaataaaataataaaatttcaaataaggaaatcaagacctcacaaaaaatcatgacaaaaataagaaataagaaaagtgaatttctgggaaaggagagagataagaatacaggaatttctatgcttatatttccaaattagcacagggcaacagattctgattttagaataatcacccacacatcatatagttcacgggtactatttacaataagtaggcggggtgcggtggctcaggcttgtaatcccagcagtttgggaggctgaggcaggtggatcacctgaggtcaggagttccagacaagcctggccaaaatggcgaaaccccgtctctgctaaaaatacaagttagcgtggtagcttgcgcctgttgtcccagctactcgggaggctgaggaaggaaaattgcttgaacccgggaggcggaggttgcagtgagccgagatcgtgccactgcactccagcctgggcgacagatcgagaattcatctcaaaaaataaaataaaatataaataaataaaatataaaaaataaaataaatgtaaaataataactaaaattgttttaagtaatgctagatctgggaccgaattcagcagaaaaggcgagcgaatgagattttgctacactgaagtttctgagtatctacaaaagtcttaattatgaactaatttttttcttacatttcaacgtactccaaaaatacgtcagaggccttaaagaaaattttatttgtttttgtatgcagtgggggcaggcggtcttaaaaagtaaagtatgtatgaaagtagaaggaactcatagtgacataaatgttttaaattctttggagaaatgtgtttgataaggcaacattgttataaaagtagaggtctttgtttctcagttggaaattggtcaaaacttttaaaaggcttcttgaaatagaattgtttcttaggaaatctcatttctatgctaagaccaagtcaacataggggggaattcgacgcgatctgaggcgtaagtcaaagcagatcatgaactcttgcagcaaacctgacctacaagcttgcccccgaccagcatagaccacgagctgcaaggggtctgagacagtaaggcctgaagttcaccgaactcagtttcaaatacctgtggtccccccaagaagggagacacgctcttcctctcgggtgctacaactggcgctggggaacggtgatgctggaccgaaaagacaagcgcagccaggcaggccaccgcggccagcttcaagctgacccggtatccccgcggccggaccgccggtctcagagggagacacagagcggacgagtcaccgagacaacgcggaaaaaaccgccccgcacgccggaggataacgagagctgccgggctgacgttacctccacccactgggccgcgacgtccccatcggctgggcgaatttgcagccgggcgtgcaggcactgctgtaggagcgcccgggcctgaggaatccggctaccctcagccatggcttaagccagcgccgcggccggacagttactaggccatgtgtcgctggcccctccctcgacgcgctggcggggcagacgaggcggggcacgacgaagggcctgcgccgattgcccagtggccccgcccttaggagggcggggcctcggactgactctcgaatgtcccggatgtgcggtcttggaggccggcgtagcgctaagcttctcggcagcacctgcccaactctgtagaaggcgctcagtgtatacttttattaaacgattgaaaagactcgttaaatctctttcctacaaaccttttaagaaacatttttcacctcagaaagcttaggttccaactgttgaaaaattttaaatctgcttgatttaaattcatgttatgcccatatgaaagtaagtaaacaaataatcgaatcataaagcaagcggagatggaactaaaagctatatatacatccttcaaaattttccttattccaatcaataaaaacaatgctgcctcctctatcgggaatgccataaattattctgattccacagttgtgaaaaggtattggtatgctatacgaatacacattctttagaagatatccttgttaaaaatgttcttatccaagaaagtatgattgttaataacttagcccgctactaatacaaaaataaaacagcttattctgatgcatatgacgtaaattctgtgatgcattttctggaagtacatattagaatgtaaataaaactaaacaagggcttgattttctttcccatgtaacgtattccttaaacatgcatcagattagcatttatttgtctatgggcttggatggtttagatgaggaataatagtgttaccctgattgcattacccaggtcattgatttgggctcagttgacacaatgtgcctatacattcggatctgttgtttaaaaagatgacatcactgacagtgttgctatccatacaaagtagtgtgactgaagaaaatagtccatgcataatcaacagtcctttgtacacaaaatcgaagctgcttgtttgctggttatcttgcagccaggtttacacttttagtaaaaacagaaagcaaaatctcacatgatctctgattgttgcattgcagggattccaacagttgttgacatttgtctgcaaagcacagacaagttgaattgcttcatgtctgcacctttatgtcattataactactgagtctcttttctctccggctctcagattcagattttacaggcctgaaagaaactttgacatacaaaccattagctatgtcccagaataagaaaagactttggtgtccatttgtatgtggctgcaggaaatagggaggtctatagagaataggttatgtggttcgcagagatctttctacagagagggtttctttaacaaattgggaaacccttcctgtgagtagaatagatggagtatggatggtaatggttagcttctcaaaaatcactaattactttaaaccctcctattgagtgaggatctcgtggacattgctgtaggtactgtaataggctgtggctcacttattttttacttctatttgcagaaggctatagagagtggccaccaaagacagcatttcctttctgtattttattttttgaacacttagtttcattctgcaaataatttaagaaggaaggacatgcatgcaataaaatagtaaaatgtgaattaaagcattagaaataaagaaactagaattatgtcagtaagccacaatgggggaaattgaaaacaggtaagacagtggttctcaactggagtgctgagatgatatagtatgcagcaaaattttcacaaatgtataactttaatttttgttataaaacaattatgttcattgtatgtagtattgaggtgctgtaggttgtacaatttgtttcaagttggaactaaaggcaaagcatagcattaagttggctttacaagaagatggtggttcactggaatgtgagagagctttgccttgtcattgtatgagaaatcattgagcagagataattctcaaacacctacaatgctgaaagtgtaccatatggataggggattaattgtggatgggttctatgtcctctgagatggtacaataactaatttagtgttattttaccttctttaattcatttaagttggctgccctaaattctggcattcaaagtatttcacaaacatgaaaagtttgagaaccatttctaaaagattccttagagttgatgctaagcttcctggttgtaaataggagaggatagggaagggcagtataatctatttcatagttctagggataagcagagcttttcctcagatttagctctcagctgagcctcttacctgagactttatataggatatgttaataaatacaagtgcaggcctggcgaggtggctgatgcctgtaatcccagcactttgggaggctgaggtgggtggatcacgaggtcaggagatggagaccatcctggctaacacggtgaaaccatttttagtctctactaaaaaatacaaaaaattagccaggcgtggtggcgggcacctgtagtaccagctactcgggaggctgaggcaggaaaatggcatgaacccaggaggcagaacttgcagtgagccgagactgcgccactgcactccagcctgggcaacagagcgagactccgtctcaaaaaaaaaccaaaacaaaacaaaacaaaaaaaaaccaaaaaaaaacaagtgcaactggaagaggtaggtatcttatcttagggaagacagtatctagccctctagtttaaagcccagatatttttttttctagtttaaagcccagagatttatttttttttgaaaaaaaaaataataaccaggttctgagaaattggttaacattaactaaaatgcacattagattggggtagaaccagaatactaatttagtcatttacaacaagaaatattgccatgacatggagtagaaattctcacatagggcatggtcagcatgtttccccctgtggtgaagcataggaagctagatcatattcagaagtctctttattaattaactatgagaaatactcaaaatcggtatgaccagcatattatttttatgtagagagagtaacacagaaatcaggatgttgcttggtaaatgagaactcgaacaaagagggtgagaaaatttttttgtggaagacacctaactatgaccccaagtactaagcacaggagacagtgagaaatatactaaactatgtccctacagcaaatgtagtatcagattttctagggcaatttctttaattgttccttgataaaatcagaatcccttgatataaccccacaataaaagcaagccttcagatgtaatatggtctaaatatactaatgtgacggtcctactctactagagattaatgcatgaactttgtgtacttcacttaatcctaatcaattttctcaactgggcttttgagaagtgttgaaccatgggatcgttcaaggtttagtccatggcaagggcttgtggagtagggtattttatattattgaccaagacactgtgatttagagatcaaaagagcaaacagggaggttacactgtatattgaaaagggaaaggccaaattaggacgtgcatttggatgaatagctatgctggttatatatgaaggtggatttaaggatttctgaaaaagtagttttgtctactataacacataaatgaaaaaattaggttcctaaagttctatacagtggcagatataattttggcttggaaaaattgtctaagcagttgtcttgacagaaaacagatggcacactttcaaaaggtgaagagaagctgagcatggtggtggctcatgcctgtaatcccagcactttgggaggctgaggctggagaatcatttcagcccaagagtttgacaccagcctgggcaagatggtgggacccccatctctactgaaaaaagaaagaaggtcgggcacggtgactcacatctgtaatcccagaactttgggaagccgaggcagatagatcacttcagctcaggagttcgagaccagcctggccaacatggtgaaaccccatctctactaaaatacaaaaagtagccgggcgtggtggcttgtgcctataatcccagctattggggaagctgaggtgggagaatcgcctgtacccaggaggtgagggttgcagtgagctgagattgaaccactgcgcttcagcctgggtgacacagcaagactccatctaaaaaagaaaagaaaaaagagaagaaaagagagagaaagagaggaaggaaggaaggagagaggaaggaaggaaggagagaaaaagaaagaaagaaagaaagtaagtgacgagaataagagagttgaaagaaggttgaatgaagggatcattaaccaggtatgtgaaaggttaaggaaaaccatcaggggatagtgaaggacccagggctagcaacaacaggaagcagttaccattctgaaggggtaagaggaaggaatagttttcttcaagaaccagcaagaactgtgggtcacacttgacaggacctgtgaccttccatagagaaatgcagcctctgccaaactgcagcctgttttccctctcctcctagctttgattgtctgccatttctctcattggctacacccagctggaagttagagtaagggttgattcagtacataaaaaaagcctcctgggacacagaataggatatagaaggatggagagtggatctgaaaggacacactgagaagatccagggcagcaactacttccagcttctatggacagagagaaatatcaatacttaccttctacaggataatttagtggcaaaatatacccctcatctgtatatccagttttctaattacaaggggctattttatgaagcaattatattttgggtgatagctgtaaagaataattattttattttgttttgttttgtttttcagaaaaagttccaaatcaataggtattttattacataattaaatatcacaaataaggctaggtgcggtggctcacccctgcaatcccagcacattggaaggctgaggaaggaggattgcttgagtccaggagtttgagacaagcctgggcaacatagcaaaaccctgtctctacaaaaaatacaaaaaaattagccaggcatgttggtgcgtgcctgtagtcccagctacttgggaggctgaggtgggagggttgctggagcccaggaagttgagtctgcagtgagctgtgattgttccactgcactccagcctgcatgacagggcaagactgtctaaaaaaaaaaaaaatcacaaatagattttaggattcattgggcatcttgtttcagaagctggaaaactcttagatcttattcatcagccggctgaacagttcctttttcagagacatagatgccatccaaaaattttctgatgtctttgattttaactgttgtggcttgctgaatcaaggcaactgaatttgaaacaagctcaatgtcatttccttcaaggattaattcatctttctgggcttgagatactgaacaaacaacatttatcctcattcgaaccctgcggatgtattttttacccaagaaattgtggatttcaacaagagacctgttctcccagaatacgatattgatgaggaagtgagcttacagagacttcatcttgtaatggaagcccacagtagcacccttgatcatgttctgtacatgactacaaatagtgtgaagggtagccagttcctttctctttccccacaagttgtcaacctggagcctcttccttttctttccaaggagactgagttctacattggtgtgattgaagtccttctgcagggttcttttggggcccttcacagtaactgtgtttcttcagagtgatatcaacattttctggaatgttgactgtctgattgctgagaatggtcttcattctgacagtatacgccgcaaagagagaatgtctcatcatcacattcttgtagcccataaggggattgtgtattcaagaacaattattttagcttaagaatatgggacaacaattatctattgaggtgaacacataatgctaataaaactacatttgtaaaagtgaggccaggcatggtggctcacgcctgtaatcccagcactttgggaggctgaggtggatggatcacttgaggccaggagtttgagaccagctggccaacatggtgaaaccccatctctactaaaaatgcgaaagttagctgggtatggtagcacagcctgtaatcccagctactcaggaggctgaggcaggagaattgcttgaacctgggaggcggaggctgcagtgagctgagattgcaccactgcactccagcctgggtgacaaagcaagactcagtctcaaagaaaaaaaaaaagtgaaattaagcttctgtctgttatcgcatcacacaaaaatgttacagaatatttaagataatctgattgggcctgtgcaaatttcactttaggggtgtccagtataatcaccgagagacagtcagtcttccactagggcatctgaaactgaggtgtgagaggcccatgtgaattctgacttcaagacacttgccacatacattaagactctgagggaaggccaggcgaggtggctcgtgcttgtaatcccagcactttgggaggccaaggcgggtggaccacttgaacccaggaattcaagaccagcctgggcaacatggtgaaaccccatctctacaaaaaatgcaaaaattaaccaggcatagcagctcacacctgtaatcccagcactttgggaggccaaggcaggcagatcacttgagctcagaagtttgagaccagcctgggcaacacagcaaaaccctgtctctactaaaaatacaacaatttactgggtgtggtggcacatgcctgtagtcccggctactcgggaggctgaggtgagagaatctcttgagcctgggaggcgaagggtgcagggagctgagatgacaccactgcactccaacctgggcaaccgagggagaccctgtcttaaaaaaaaaaaaaaaaaaatatatatatatatatatatatatatatatgaatacatatttatatacattatttgtatatatatgtgtgtgtgtgtatatatatatacatggttgtggtttgaagcatttgcccttgtacttttgatttcaggctcttatttaaatctgtttgtttcctcttccctcagagtcttttttttttgagacacgttctcgctctgtggcccaggcgagagtgcagtggcgtgatctcggctcactgcaacttttgtctcccaggctcaagagattctcccaactcagcctcctgagtagctgggactacagtcatgcgctactatgcctggcaaatttgtgtattttttgtagagatgagatttcaccatgttgcccaggctggtctcaagctcctgagctcaagtgatctggctgcctcggcctcccaaagtgctgggattacaggcgtgagccaccgccactggtctacaatcatatattttatcatagagctgtttcttaccataggcagagactgagtccaggagtatcggtcctgtggaagtccctccacatgaaaatataagacctagaaaaataatagtttccacctaatagctgactctatatttaagatgaatagtttgtataaccaggaaggagatggattttagattgaaacttaatattgattgttactttattcaatttgcttttttaattcttattttattactgcaacatttgctattgtgttgcctaggtaacataaacaagtgcttttaactctaaggcagtgatgtatatctttggcagtctgtagggtttcccaggggaggctgataaattatcttgatctttgggttatttttcagtttacagtgttgtaataacttagcaatgcattctatgatcttttgaatatttgtgtatgtctgttagcctttttgccaagtcaggccagtctgttttaagggctttttgtaatttgggccctgtatcctttttagaaagaaattgtgaaagattttgaattgggcaaaagagatttgtggatattattgtaatggaatgctggagcctctgggaattacctggtcctatagggctatcttatagggcttacttatctttgaccaggctgtcttacaactctgcaaagatagaagtaaacttctatcttcaaatcattcctatctataaaaatgtaaaattgtctttagtggaatgaaactgattattaccttgtggatattgcctagttttgccagttttgcatccatttgaagttcatttcagtattcttaacctgattataaatgtgtagttctctctcttgctctctctcttttttttttttttttttttttttttttgagacagagtctcgctctgtcacccagtctggagtgcagtggcactatcttggctcactgcaacttccacctctaggttttagtgattcttgtgcctcagcttcccaagtagctgggattacaggtgtacactaccatgcccagctaatttttttatttttaatagagatggggttttgccatattggccagcctggtcttgaactcctggcttcaagtgatccgcctgccttggcctcccaaagggctgggattacaggcgtaagcccctgtgccctgccctctctcgctctctctttttttaagctttttacttttgaatagggttaggtttagatttacggaaaagttgaaagataatagagagttctcatatactccttgcctagtttcccctactgttaacacctcaaattactacggtacatttgtgacaacccaggagccagtattccatactttatttaattccatgctttattcagatttcactggtttttccctaaagtcctttttctggatcccatccaggatgccacgtttttagtggtggcaaatccatacaagtctgcagcaacctcagttcttacctcctcagaagaacaaatttgactgaggggcatagtgagagactgaggcaagttttagagcaggagcgaaagtttattaaaaagttttagggcaggaatgaaaggaagtaaagtacacttggaagagggccaagtgggcaacttgagagagtcaagtgcacggtttgacctttgacttagggttttatatgttggcatacttactgggtcttgtgtctcttctcccctgattctttccttggggtgtgctgtacacatgtgcagtggcctactagctcttggaaggggctgcatgcacagtgtgtttactggagttgtacacgtgctcacccgaggtgttcttcccttaccagtcaaatgttcctagaaggtcatgtaccagttaaactctgccactgtgcctctttagtgcacatgcctgaacccagttgcccaactcctgagatctttttttttttttgagattgagtttcgctcttgtctcctgggttcaagcgattctcccgcagcctcctgagtagctgggactacaggcacgtgctaccatgcctggctaatttttgtatctttagtagagacacggtttcaccatgttggccaggctggtctccaactcctgacctcgaagtgatcctcccgctttggcttcccaaagtgcttggattaccggagtgagccactgtatccagccttgagattttatcaggcagctgctgataaccagtttcaggttttctgtatctattgggagactgcctttccctggcaccggctgcagccaattattattattattaacttattattgttacagtgcaacaactgacacatcacctgatggtggactgacattcctggttggggaggtccctcctctgccctgttcatttctgactggctacctactgtaacaacattacatttagtcatcatgtttctttaggctgtgacagtttcttagactttccttgtttttaatgactttgacaattttgaggagcactggtcaggtgtattgtaaaataaccctctattggaattggatttttttcaatatacatacatactgtatatatatatatatatatatatatatatatatatataacctctataattatacgcagagattatagatctttggaggcagatcacagaggtgaagtgccatttttaacacattatatgaagagtacatgctgtcaactgtcttattgctgatgatgttgaccttgatcacctggctaaggcagtgtttgtgaggtttctcctctataaatttatacctcctctcatactttactcttttgaagcagatcagtaaacgcagctcatactcaaggggtgaggagttaaaatccatctctttatgtagggagtatctatatcgattactaggaattcttaattacaaaagattcgagctggagtgcagtggcacaattttagctcactgcaacctctactcctgggctaaagcgatcctcccacctcagcctccctagtagctagaactacaggtgtgtgccactgcatctggctaatagtttaaaaatattttatagagataaggtttgctatgttacccaggctcatcttgaattcctggcctcaagcaatcctcccacctcagcctcccaaagcactaagattacagatgtgagccactgtgcccagtgtttgagttcttctttgaactgattgttctctatttctggttctctccttattgagttgaatattaatgaaaaaaaattgatacatgttgattttacatttgtatgagagttctgattttaatctcttttaaaatttattttttcatatctttctaccaataaatgttatgggaataattttttacatagttctttgaaatccatagataaatgctataaacaaatgcattccactttgggaggctgaggtgggcggatctttttttttttttttttgagatggagtctcgctctgtcgcccaggctggagtgcagtggcgcgatctcggctcactgcaagctctgcctcctgggttcacaccattctcgtgcctcagcctcccgagtagctgggactacaggtgcccgccaccacgcccggctaattttttgtatttttagtagagacggggtttcactgtgttagccaggatggtctcgatctcctgacctcgtgatccgcctgcctcagcctcccaaagtgctgggattacaagcgtgagccaccgcaccaggcccggtgggtggatcttttgagcccacagattagagaccagccttggtacttcagcttgggtgacagagtcagaccctgtctcaaaacaaaaaaacaaacacaaacacatccttttgaaaagaaataaatattattatagtcaaagaaaaaaatgtgaattattttatcacattgactgtatcagtcaggatcccatcagcaagtaaataacactctaaacaggataacctgcgaaagaaaggtttatttacagagactattgatgaaggtgtgggtggagtagaaccgcagaggttaatgtagtaaccaaggacatagtagcagctgagattttaccatcccttgggcctaaagggagaagtggggcttgggggaatctggaatccagaggtagagatttgcgtagatacttgagaaaaggagtcaaccctctgccaagaagtacagccaactccaactccaggtgaccgttcaggaaggaagctaggagaatgatatggtttggctctgtgtccccacccaaatctcatctcaaattgtaatccctacatgttggacggagggacctagtgacagacgattggatcatgggcgctgattccccaatgctgttctcatgatagtgagtgaattcttatgagatctgatggttttaaaagtggcagtttcccctgtgcactctctctctctcctgccaccttgtgaagaaggtgcttgcttccccttcgccttccaccatgttttaagtttcctgaggccaccccagccatgcagaactgtgagtcaattaaacctctttataaattacccagtctcacgtagtatatttatcacagtgtgaaaacggactaatacagggaataaatatgtggtgtgatgatatatattggttttcatccagggctcctggcttataactcccatagcctttattacagtcctttgttatgatgttggatgtgttaggtctcaggggcaggactctgaccttctccggccctcctttcacctgccccaaggcaggactccagttttctgattgtgggccttaagatcctcccatgagaaggtcccaccctagaccctgggggaagggatgctgacatcatgaagcttccaaaaaaacccgagaggacagagttcagtgaacttctggagacctgaacatgtaggtatagctaaacaataatgaacacatgaaggttcctggtgggtggtgtgcagggcatggaagctctgcaccccttccttcatacctcactcttcacttctcttcttctgtattgttcgcaatagcctttataataaactggtaaatggaagtgtttccctgagttctgtgagccactctagcaaattaattgaacccaaagacagggtcatgggaatcccaacttaaagctggtcagtcagaagttccagaggctcagacttgtgactggtgtgttgggaggggcagtcttggggactgaactgtcaatctgcaagatctgacactatctctgggtatagagcgttgaaactgaattagaggacacccagctagtatctgctgtttggtgtgtggggaaaatatccccacacattggtcacagatatctgtgttgatgattattgtggtgtgagggtagaggtaaaacatggttaaagttttcccttcacaatatacttgactatattttccatcttctttccaatttctgccagggctccccattggcaaaatcaaaccagaaagcatggagacccgttgatatgatccatagagggcatcctctcagaacagagagcaatgtagaaaatgctctggtgtggatctgggggacaagcaagacatatctaatacactgatttaaaaggcctcaaagtctacaatggggactcttatgtcatttttttgttggaagatgatagctaggaatatgaagaaagagatgactacggttaatgtttttgatggaaatctttaatttctcaaagattttagagaagaaatctttaatttctcaaatattttagaaattttttttgagaaagagtctcactcttttgcccaggctggagtgcaatggcacaattacaattcactgcagcctcaacctcccaggcttaagtgatcctcccactttagcctcacaagtagctgggactataggtatgcatgaccatgtccagctaatttttgtattttttgtatggatggggttttgtcatgttgcccaggctggtcgtgaactcctgggttcaagcaatctgccttccttagcctcccaaagtgctgggattacaggtgtgagccactgcccccagccaagaagtgaaatttgacttagtgaatcaaggtccttgacttccccattcccttctttatttcagccattgggaatatggcaagacatcagaagagaatggctgctgggatcctattcttggtgagaatgcccctgacatggcccaacttggcatggcaggaagggatggagccgctgcctttaagggatcatgcagactggaataagaggcatattagtagggaccactaagaacctaagtccttaaggctgtcctgcaattctctggactgtggaggaagggatttggaatcagatttgatttgataaagaaaaataatgaactatttttatgaaaactaaataattgaaagctgtcaaagattatgacagagaagtctatcatggctgactccatcttgtttctagcttcccaggctgcttgtccttgctcattctttggtgtaggccaagctgactatgggaggaatttataatttaattttgaagtaaggatgataataatgtctccttaaaattaactcccttcttgctcagggatcaaaactgccttcgtaaaactaatgaaaggccaagaggttaggattatgggaggggcctgaattctgctaaaatgtaggtatagctaaacaataatcatccattgtcccctagtttgcccttttataatcccttgctgctcaagactcatgtggccagaggttgcaagattttgtgacttccccaattgctcctatagataacatcattatggtagaacctgagattagtcttttgacaggtttttcagacttttgcattctagcaactgactgattccacttggctgggactcatgactcaactggtcccatggctcctacccagaagtggactcagcgcacgaggaccattttctacacctctatgatttcatccccaactaatcagcatcacccattccctaacctcatgcccaccaaattatcctagcgtctgagttcttggggagactgatttggtaataactccagtcctaccacttggctagctctgcattaataaaactctttatttactgcaatactgagttctcagtgaattggttttgtctgtgcagtgggcagggagaagctgttgagcgattacattattgtctttgagtcttataactaagtgaagttaatactgactgcacaataaaataaatgaataatagagattttaataattaattgttcatatacacctatatcttaaatttcatttacttgagatgaacaagggagagcagtattattagatggcagctccctgattgtttgctccttttggcaggtgaagcaaaacaacatgcttgagggacaagatccctcaaatcccacaaataacagaaaaaattccaacttcagaattaattaataactgcattcatgtatttattcaattttaataaatagtcattcatcattccaccctgagctaggtgttagagatagatgagaaataagacactgttcttacagtgagtttagagaaaaaacaaggaaaataaggaataacattagaaaaaactcttatttctctccccaccactgtattttttccctcccttctgcctctcaatcaagaaaggacaggacttagaaggaagccacctcctggaaagcctgaactaaactaaagtggggtgactggccctgactggagggaaggcttgtggcccaaacaatttgacataaaccagattttcaggctcatagaggctccacctctaggcaaatcttttcttttcttcttcttcttcttttttttttttttgaaatagatttgctctgttgcccaggatggagtacagtggtgcaatcttgctcactgcaacatccacctcttgggctcaagtgatcctcccacttcagacccacaagtagctgggactacaggcctgcaccaccatacctggctaatctttgtattttttgtacagatagggtttcaccatgttgcccaggctggtcttcaactccagagctcaaagccatccccctgccccagcctcccaaagtgctaggattagaggcatgaatcactgtattagtccattttcacactgctataaagaatacctgagactgcgtaatttataaagacaagacatttaattgactcacagttcctcatggctggggaggccttaggaaacttataatcatggcagaagacaaaagggaagcaaggcatgtcttacatggtggcaggagacagccagggccggggaaagccaaacattttaaaatcatcagatcttgtgagaactcattcactagcatgagaacagcatgaggaaaccgcccccataatccaatcacctcccaccaggtccctctctctacatgtggggattacaattcaagatgagatttgggtggtgtattagtttattttcatggtgctaataaagacatacccaaaagtggaacaaaaggaggtttagttggacttacagttctacgcagctgggagccagaggcctcagaatcatggcaggaggtgaaaggcacttcttacatggtggcggcaagagtaaaataaggaagaagcaaaagcggaaacccctgataaatccgtcagatcttgtgagacttattcactattacgagaatagcatgggaaagaccagctcccatgattcaattacctccctctggttccctcccacaacacgtgggaattctgggagataaaattcaagttgaaatttgggtggggacacagccaaaccatatcaggtggggacacagacccaaaccatatcagctaccacgccctactagcaaatcttttcttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcaaatcttttcttaaatgccagctgacttgctcttcggaatacctttctgtctcttttctctttcatagcacttctttgtacacatatatactgccttcagagtctccaaaatttgccttgggtttgacttccgactccaattgtttccttcctctaggccacaatcaagagtctgatattctaagtactgtgcttagctgtactctcctataggtgaagccgattaaagtaatttccattaacttgtgaatgaaacttaacattcttaaaaggtgtctttgcattttaatagcagccccttaacacaaattaatctctatttggtaagatgtgtgaaagttactttttgtgggaagaaagagggtgaattattccttaattctctgtttaaaagagttgctactctcagagcctctggagtctcatctcccagtcactccccagcacaaggcaattttgcttttcttcctgaagctaatcactgaaaaattctttaggttaaattcactggacatattttagtcatctctcttaaccaatctgtacaccctacatcttgaaatgttgtgtttcctgacaggagacttagttttccttctctcttttccatatgctccttctgaagttcctgtcatgggatcacctctgtgcttgcctctaaacatcagtgttccagcctcagccttgagtgctcactgtacacactcacctgaggctatgactctactcccatggctttagttactgttcattcgttcatctattcaatactttttttttttttgagatcgagtctcagtctctcacccaggctggagtgcagtggcgcaatgttggctcactgcaacctcctcctcccaggttcaggtgattctcctgcctcagcttcccaagtagcccgccactatgcccggctaatttttttatttattttttatttttagtggagacggggtttcaccgtgttggccaggctggtctcgaactcctgatcttaggtgatagtccattttaatgtctctcaggcatgagaaataaaaatagaattctaagtctccaacctgactgaacagaccccctctcggcaaaggggaccccagagaaaccttgaaaactctcggtcgtgatgggatgggaggtcagacataccttgctgtactccctcccacgctaactgccattaggctttcttcccttaggactaaacagaaactagtcctttcaaaagactccacccttgatttcaaccaaaggcctgaacactgcctctcttgcagtttcaacaaaacaaccaaccagcatttcttccttatgagagatcaccgaccatggagtggtttggccagtctatggagaatgcacagtgagggcttttgtgtcctctgcttcactttttgacatcaggaggcctaaaactccactttcagataacgctaatgccgccatttttggaacatgggtcccataaagaagcatgaagctcaattacacatgcacatatttatcctctcataaatattcaggactccttctatagcttattgaatactgtatatttagctacccttttcagcataaattcctgtcttattcttctaacctttaaagtgcctgtttctggcttctggctggaggttatgcttcaaagcctgtcacaatgatcaccctgcaggctgcaattttttatgagaaataaagttcttctttccaaatttatgagccttgtcattcttcagttgacaggcacctgaaacttagtatgtctgtattagtctgttttcacactgctataaaaacatacctgagactgggtaatttataatggaaagagatttaattagctcactgttggaaggcgagacaggcactttcttcacaaggcagcaggagagagaaaagcatgcaagagcaaggaaaactgccttataaaaccatcagactttgtgagaactcactatcgtgagacgagcatgggggaaaccacccccataatcgaatcatttcccttcctcaacacatggggattacaattcgagatgagatttggatggggacacagagccaaaccatatcaatgtccaagactgaacttctttacctgctccttccttcctctttttctttctttctttctttttcttgctttctttcttgcttttgttctttctttcctttcttctttcctttccttttttctttccctccctcccttcctttcttccttccttcctccttccttcctttctctttctttctttcctttcttctttcttttccttttttctttccctccctccctcccttccttccttccttcctctttcttctttccttcttccttccttcttccttatttctgtaaatggaaaccacgagctgtctccgaatacagaaatgtatgcatttgtcatattctatccatcatcttttgaatggcttttatatttggggaaattcctacattttgagtaaccccttctcactcatgtagaaatcagaacttaaattccccagcctcatttgcagctaggatacaggcatgctgactagatatccttgtgcaagactaaatttggaagtgagcaatgtgaataagcaagctctgcatgagatttctgtcctgttgtcagagctttcaggcacagagtggttcaagacctaatgcagaaatggtatcagcggcagtagcagttttagtaaagccaaattgctgatattttgggctcaacagcagcagcagcaacatttggtatcatttactgaaatacggaacaccagtgacaaattcctgatttgggtagttttgtggcatgttttgggcatggtttctgagagctgctccttgaatgtttctccaactatcctaataattctgtgagttacttaatgtcttttaataaatcagtttttgcttaaatcagccagaatgaaatctactgtttgcaacaaagaacactaattgacagaggaattgtcctcaacttccccttcaaccaacagaatttacagaactcgacttttcttgatccttacttacacttttttagtaggccacatcatctgttacttagattactttggcactgtcctatttggccacccacctctagttttgacctctctactgtagtagacagagcaatctatctttctaaaatgcaaatctcaacctatcactcttaggtttaaggtctttcagtggcttccaaatgccctcaagataaagtctaggatcaagtccaaattccttcttataggctctcaggatctagtcctggttgacttttccagctcatgtttccagcctgcttctcacacttaatgttgcaattatgttttttggcttgtgctggaccagcagcaacaggatcccttgggatcctgttagaaatgcagaatctgggccgggtgcagtggctcacgcctgtaatctcagcactttgggaggccgaggcgggcagatcaggaggtcaggaaatcgagatcatcctgggtgaaagcccgtctctactaaaaatacaaaaaattagctgggcgtggtggcgggtgcctgtagtcccacctactcgggaggctgaggcaggagaatggcgtgagcccaggaggcggagcttgcagtgagccgagatcacgccactgcactccagtctgggtaacatagcaagactcggtctcagaaaaagaaaaaaaaaagacatgcagaatctggcctggagtggtggctcacgcctgtaatcccagcactttgggaggctgaggcaggtgggtcatgaggtctggaattcaagaccagcctggccaagatggtgaaaccccgtctctactaaaaatacaaaaattagccgggtgtggtggcaggcacctgtaatcccagctacctgggaggctgaggcagaaaattgcttgaacctgggaggcggagcttgcagtgagcctagatcacaccactgccctccagcctgggcgacagagcaagactctgtctcaaaaaaaaaaaaaagagaaatgcagaatctgacttactgaagttagatttactccaggtttactgaatcaaatcaacatttaacaagattattaggtgattcatttgcatattgaggtttgggtagtgctgctttatagcaatgtcttctctttccctccagggctcttacacattctgcttcctctctttgaaggaactatcctcctcttctttatatgcctaacactgttctgcaggactcaggcccttatccaggaaaacttttttgactggtgaaggcaggaattaccattttactcctttttctttcctactaaactggagttttctaacctaattgtactttagacttaatctgagaataaaaaatatactggccgggtacggtggatcacaccgtagtcccagcattttgggaggccaatgtgggtggattgcttgaggtcaggagttcgagaccagcctggccaacatgacaaaagcctgtctctactaaaaatacaaaaattagctgggcgtggcagcacacgcctgtaatcccagctactatggaggctgaggcacgagaattgcttgaacccaggaggcagaggttgcagtgagccaagatcatgtcaatgcacctcagcctgggtgacagtgagactgtttcaagaaacaaacaaacaaacaaacaaagatactggttcctgcgtcctgcttctagagattttagttttaattggtttggataaggccttgaaactgacattttaaaaaagtatcccagatgattacaatgtggagccaaattcagaaccactgcactagacttcaagcttctttaggacagggattgtgtcagattcactcttgtttccccagtgcctatcacagtgccaggtacatatactatactggtaaatgattgtttcccctaatttctcagggatatggaatcagatttgtgttgtacacagcattctatcttataccctaacccctctcacacacgttagcatctgagcatccttctcatcaaaacaaagagctacttcttgaggaaagaacttacactggcatttaaaatgcatctctaatcatccttgtattttgttcttaaaccagtttgatactgatatagtgaagctgctttatataatcgagtgctgacaggcacattgttttgaaacagtgtctctttgtaccagttccacagagcaaaaccaccaactctttgtttataaaccttttgagtcctgagaattcaaaatagtgaggaggttgatgagatcaacgcaattataatgagtagatttttaaaaaattaaccagttttctgtgaggttaaaaatgcatttgggaataattttcttaattataccctattttcttacatttaaattgactttaaaaaaactcttaatatcttatatttatacagtgctttacatgttgtaattgtgcaaactcaacttttattaaatatcttttattatcaattgtgtataatattatagaaatgaaatgctatagttgatagaattctttctgtccctgagttgtttacaatttatagaaagatggaacaaaatacttcaaaaagccctgacctaggtctcatgaaaaagacaatttaaagcgtacatagatagctgtaaggaatgacaacatatggcttacaaataccacaaaatccacgctttccagggcatgttccttgtttattattgtagcaggcctgaggaggtagacaaaaggcactctctgtagctgctagatttccaaaatccaaatcttgtttcaaagaatcctatgttgcattcaataattttctttcttaaatcctgcatcataaaactaaaacttcagtgggcttgtcaggacctgggatagtgtggggtggaaaaaagcaccatccatttctcattgcagctgtagtcggagccacagcctggtcatcaattcatatctccctttccgaaaaagaaaaaaaaaactgttcaagcttcaaaaccttgaaatagggtcagcaattaaagttttcatctacccaaagcttttgtcattccaagtaagagagaccaagcccccaattgcccaggggagccctgataccacgtcaattagcaggatttctaggacaccaaactactgttactttctctataaaaagttagtcatgaagattaattttcttctttctgtatctccttgtaattcatatcatacgttttggggatttctgcgtaggctatatgcttgcggtttggaatgctttgtacaaagcatgctggtgtattcagggactgagtgtgggatgtgacccaaatatctccatgttgtatcagttgaactaactagatagttcagttgatttagaattgacaggactacctattgattgacatgtattgattgattgatagaattaactaaatacaaagacaataggtgagtgatattatgtggttctacataacttaggtgcagtcacttagtacacaaagcttgaaacataacctgaaaatcagagaacacaaattaatattgttattgcatttataaaattaagtctatgacaacaggcagattcttgaacattattttagccccaaattttggagatagcttactctataaatattagaaaaagacagttaagatgccttaataattaaaacactaaagtagaagtgtctttatgctttaacatggatgtaacaagatgagtgccttgtggccgggcgcggtggctcatgcctgtaattccagtactttgggaggccaaggtgggcggatcacgaggtcagaagatcaagaccatcctggctaacatggtgaaaccccgtctctactaaaaatacaaaaaaattagccaggtatggtgatgggcgcctgtagtcccagctactcgagaggctgaggcaggagaatggcgtgaacccgggagacggagcttgcagtgagccgagatcatgccactgcactccagcctgggcaacagagcgagactccgtctcaaaaaaaaaaaaaaaaaaaaaagagataagtgccttgtcacttccatgttaagttttattcataccagttaaataatttagatgttactaaataatgagggagctctgtccaaatgtctgtcagaagattctgtgacagaaaattcaaatccttggatactattgatcaatttggcaactgatattcctagcttcaaaaatcaaaagttttagctggacatggtggtgtgtgcctgtagtcccaggtactccagaggctgaggcaagaagattgattcaacctaccagaatgactacactataattaaaaaaaggaaaataacaagtgttggcacagatgtggggaaactaaaacgtttatacattgctggtgggaatgtaacatggtgcaaattgaaaagctttatgatttctcaaaaagttaaacataaaattaccatttgaaccggtaattccactcttaggtatatacctacaataattgaaaacaaggactgacacaaatacttatatacaaatgttaatagtagctttattcacaataatagtagctttattgacaatagtcaaaaggtggaaacaacacaacagatggctggatttaaaaattatgttatatacatacaataaaatataattcagctgtaaaaagagaatgaagttctgatactgcaacaacacagatgaaccttgaaaacattttgctgagtgaagtaagtcagacacaaaagggtaaatactgtataatttcacatatatgaaacatctagaataggcaaattcatagagacagaaagtagactggagattattagggaccagggggaggaggaatagggagttactacttaatgggcacagagtttgtccttggaatgatgaaaaattttggaaatagatggtggtgatggttgtacaatttcgtgaatataattaatgccactgaaatgttcactaaaaatggtgaaaatggtaaatcttatgttacacatatttttccacaataaaaaatgagtcgaaataatcataggtccagcacagtggctcatgcctataaccccaacactttgggaggttgaggcaggcggatcacttggcaccaggagtttgggaccagacgggccaatatgggcaaaatcccatctctactaaaaatataattagctgggcatggctgggtgtggtggctcacgcctgtaatcccagcagttttggaggccgaggtgggcagatcacgaggtcaggagatcgagaccatcctggctaacatggtgaaaccttgtctctacttaaaatacaaaaaattagccaggcgtggtggcaggtgcctgtagtctcagctactcaggtgcccgaggcaggagaatggcttgaatccggaaggtggagcttgcagtaagccgagatcgcaccactgcactctagcctgggtgacagagcgaaactccttctcataaaaaaaataaaataaaaaataaaaaaattagctgggcatggtggtgtacacctgtagtcccagctacttgggaggctgaggcataagaatcacttgaacctgggaggtggagtttgcagtgaacctagattgcacactgaactccagcctggacgacagagtgagactctgcctcaaagaaaagaaaagaaaagaaaagaatcacatttgcagcatgatcttgcaaattgcttgttttcttgcagcccttttattgctcagaaatctaactatagtacagcctagttatctctctaatatagggactatagcatacaaaagcagaaggtatatcctattggtataattgaccaagtgcgtgtttgcttaagaatctagaatttaaatttaggcttctgagtttaggtttgtgtcctttctacagaagaatcttcactaaatgttgactcaaacagagcaagaatggacttcttgaagacctttttgaaattctccccaacaaataagtagagtgtgggagaaaagatagtattgaaagaagtggttagcactgtaagtatcaaagtcaactctaaaagtagtgactggttcgtagtgagaagtaagccctggtgtatatggtagggcatccaacacacaaagaaagagataatggcagtcatcataactttgaagggcttgctggatttaaacaggctcctctctttcaccttgctggctactctttcataacaaaagatgatgatgaagaaaggcagaagaaagcccagcaagaagcggctgatgaaacaggccacatgaatccactgccttgatgcttgcatctccttgctttcccagttagtagacacagcatagttattttggcaagtcacctttcctttacggtcatgatgtgtctctctgaaaatcaaataggggatgctgagggcagcggctgaaatccagactcccaggacaatgctggaagcccagcgcggggttcagtgctgctgggaccacactgggtgaagagtgagaaggtaacgatcaagaccgatggccgaaaggaagaaaacagaggtgaacatccccagagacaaagtgccattgaagaccttgcacaaggcagttccaaagttccagtgattgtcttgaagttgggaggtggccataaatggcagaatcattgttgaaataaaataagagagaatgagatgaaaaaataagagagtattgacagtctgtttcatcttgaatcttagcacccatagatagaggccattggtgatggtaccaattatagatgaaatgtacaaagaaagggcaataatcatttttgatgcaggagctagaaactgagtgctgtttcttactaaagtagaggcattgatcaggtaatcagtagagttgatcagatccataatgacctgtggagtgagaaacagtgaaaataacaacaagaaaaagcaaaagaaaaggttaaatgtaaaaatttaaagagtaattttttacatagtgatacttctagtccaaatgataatattttaacagcagtaagcaaaatatttctgcaaatcaaatatttttctaaggtctatacttttatgttttaatgaggaattaagatcagatgaatctgagcatcaaaaatagaaatatatggatgaaatgaaataaatgtgaaaagaagtaaatgttgggacattttgacaattgttcaataattaggtagttaaaaatctattttttttttctgagataggatctcactctgtcacccaggctggagtgcagtggagtgattacagctcactcagcctcaacctcctgggctcaaggactcctcctgcctcagcctcccaaggagttgggactacaggtgcacactaccaggccggataatttttttgtttgtttgttttgtagagatggggtctcactatgttgcccagcctggtcttgaacttttggactcaagtgattttcccgcttggcctcgcaaagtgttgggatgacaggtgtgaggcactgcgtgtggccaaaaatcttctacttggacgttaaccagaagtctgacactttttgatgggcaaaacttcttgaataaggcaatgtagaatgagtcttatttgacttgtgagggcaaaagtagctaatgaaatgaatttgaataacaaaaataatagcaatgttgcaaattagtagttatgggttttataattagatttctctcatgagctaattatatatagtaaatactattgtctagtattctaatactcagcacataacagtaataactaatattcatatgggagctgtaagccactgcaagattgtgaagtaccttcagaatcatcaacaaaagagggaagtgtattgtaagatgtagtaattttttttttttttgagtcagagtcttgctttgtcacgcaggctggagtgcagtagcatgatcttggcttactgcaaactctgcttcctgggttcaagctattctcctgtctcagcctcctgagtagctgggattacagacacttgccaccacgcccggtgaatttttgtatttttggtagagagagggttttgccatgttggccaggctggtctcaaactcctgacttcaggtaatccatccaccttggcctcctaaagtgctgggattacaggcgtgagccactgcgcctggccaaatgtagtaatattaatagttcattcttgaggaggggacaaaaaggagaaaagtcaccaaactcatatttatccaatatttgtggtatgccaggaactttctataaaaatcatttctggccgggcgcggtggctcatgcctgtaattccagcactttgggaggccgaggtgggcggatcacaaggtcaggagatcgagaccatcctggccaacatggtgaaaccccgtctctaccaaaaatacaaaaattagctgggtgtggtggtgtgtgcttgtagtcccagctactcgggaggctgaggcaggacaatcgcttgaacctgggaggcagaggttgcagtgagccgaaccgagatggtgcccctgcattccagcctggtgacagagcgagactctgtctcaaaaaaaaaaaaaaaaaattctgtttttccttgcaaagcctgtgaagcaaatctttgaacagaggggaaagtgaggcttcgtagggttacatgtcttatccatcaatatttcccaccatgcctccattgtaccaggtgggaaactctactactgttttatattacttctttgaaactcagtaattcatatgtagtgtttttaataatgctcagatgatttagataatcagagtgtttgattatctaaaatatccaatttcttggataatggatcccatggtatcaaaaatataaacctgagaatattttggaaaatagctgttataacagagtcatatcagcaaattggttttagataaattggataaagcaatggaaattactaatgatgcttttttcctcactaaacaaaaacattctaagaatatatacagagaagtaagataattgctatttattttatttttgtttattttttagagacagggtctctctctgtcacccaggctggagtgcagtggcacgatcctagctcactgcagcgtggaactcctgggcttcatcaatcctcccgcctcagcctccagatagctgggatcacaggtgtgcagcaccacatttggctaattttaaaattctttgtagagaaaagggtcttgctgtgatacccaggctggtcttgaactcctggcctaaagtgatcctcccacctcagcctcccaaagtgctaggattagaggcatgagctgccgtgcccagccataattgctattcaaaaatcacaacttcctaagttaattctgccttctaagggagttgcaaaatttttctctaaagtagaaaaatgattcttcatgaaaataccttagtagtcttctttgggaataaaaagtggagtctgaagcatatgaaatggacaggcaatggcaaataaaagaatgagaacttgagagagaggttttgtgaaggccctgggaccttaagaagagggtggaagacgaggatgattttaagacaggcagcacagaaaaaaactcagcaggatgttaggagccctacagaggagaaagggtcaatgaagtattctgagaagcagaaatgacacaggggatttaaaaataggaatgtctaataattataatctatttgctatgctttgatatggtatagtgtcccttttccccattaaccctcagctgtcttgtgttggtggtggttctggggaatcaaagtctctgtggtgtttttatccatggagtatgtgtagaggtgtgtctgtgatcagtgtatgtgtatctcagtgtatttgtgtgatctctgtgtatgtatgtgtctgtggtctttgtatgtttttctgtggaatgtgtgtatgtgtagtgtttgtgtgtttgtgttgtatgcgtgtggtctctttatgtgtgtgcatatgagaaactagatacccgaattatgggaaagatttttttttaattgtgcatctgagctctagaaggacatctgaaagtaatgtagaacatgggcaaaatcatagtaaaacttttctgatcaatgttggtagtgattctgaatatcatataaagtttcctaggaattctgatttattgcacataaccaggagatttcttcatccttaaacacctttaaaatgatgttaaagtacttgagaataaataaatggggcagatctcagactctggcatcccacagacctgggtttgtatcctacctctaccacttaccagctctgcaagttcagataacttgttgagactttttctcctgctaagcccctcagtttttttttttttttttttttttttcagatggagtcttgctctgtcccccaggctggagtgcaatggcgtgatcctggctcactgcaacctccgcctcctgggttcaagtgattctcctgcctcagcctcctcagtagctgggactacaggcacctgccaccatgcctggttaaattttgtatttttagtagagatggggtttcaccatattggccaggctggtcttgaactcctgaccttgtgatctgcccgcctcagcctcccaaagtgctgggattacaggcatgagccaccgtgcccagccacaggcggctttcaggaagaccccacctccacttgggaacactgagctgctggcgcaggggaaggccacaggagcatcgggaagctaatgtgcaataagcctagagggtcaattcggatgatagctctaggataaacctactagtccagagaatcttacctcagacctgtatcttcatgccagattggtcttgagcaggccaaagtgactctacaccatcaatttctcactaggaacagagtgaacaaaatcagtgacactttgccttcatttcatatgtctttcttcttgctgatgctactccccaagcttgaacttgctattatttaaatactcagtgaggtcttttcctctttttggttcctttttttctgtggaatttactgctatagaggtatagagaaatgagtacttcttcaaattatttctccattttgaggggcattaaaaaaaatctgtaagtgaccaagtgcagtggctcacacctgtagtcccagtgctttctgaggccgaggcaggaggacaacttgaagccaggagttagagaccaaaataaaaaaaaaaaatagccgggcctggtggtgcacacctggcacacctgtagcactagctactcaggaggagaggctgaggcaggaggatcacttgagcccgggagttcgaggctgcagtgtgctatgatcatggtggtgaatagccaccacactccagcctgggcaacagagtgagaccctgcctctcaaaagagagagagagagagagaatgaattgcataagctaagtcatttcatttaaaaggttaataaacttgtttcgggtgttaattcccttctcgtattgggtcatcccgccaggcacccactctgcctcaactctagggtgtttattagcagatggatggatggtgttgggtacataaggaggtggtaaatatcaggcagagaccaaaataaactctggaaatgagctatctaatctttctggacagaaaatagttagaaggaaaaacttaaatactgagtttcacattaaaatggaatttatgaggacaggccagagatttatattattcagtttgggttgatgaagactgacaggcagaacaatctgcatttgtatgatggttgtagaacggttggaaaaaaacagaattggttactacatcctagaagatgatctcattataaggaatcttccaacacaggtaatgcatttatgaaccattactgactgagttctacatttcctatgttcttctctctaatctatctctgaaattttttttggatccccttctgtgctgacctcagtgtcctgatttttttcctgcctgctttcctcttcatctcttcattaccagtggagaaaatacatcaaaaccactgtgcagcgttggtggtcaagagtttaggaatcaaaaccattacccagtctttgttagacttagaattttaaaactttaactgctagattgtagccttattaaaaataggcttaaatttcagttcttaattcatttgtggctgtgaccttcaacctaagaactgatctttgcaggttaaggataaattttcaaacctgctactgtgttttaaaagggattttaaaaggaattttgacaggctttcatacccttggggttaattcacagatttggaagcaatctgagatattatttggtccaaacccactaattctgaagattagcaaactgagactcagagaggttaaatgaattacaaaaggttttcaccaagaaaagctaagggctccttcttatgctatcttctcaattaaaaaaaggaatttgggccaggcttttcctcttctcccctcactctctgtttctcaattctataatttctaaaattcataaataacaaatatattagggactagttcttaacttttctcctcaaatatgtactagggctagtacaaccattagatagcctaaaatttgattattatatatctctcctcagaaatacccttaatagtgagtattttcctcccataggtgattaaaccaatgatattaacaatgttaggaaatacacagagtgtatttgaggaagtaattctcttctgtggctttagtaatgtggcttctttcagttcacttttcatatttcaaatcaagtcagatgatttcaaaaaagaacttatggaaatggaaacagttttatgttgttttgatataaccactgtttgaagcagaaatgcagaagcagatggtactgctgaaccaaatgtgtgaaaggctagtaactcatagatgcatataatttttagagttggaagagaccaaggagttaaattcatctaactcccattctataagtatttcagatgactgcagttgtgtaagttatttatgaatatgatttgtctgcttataaatgttgtgcctggatgactgtccttagtatacttgtttatgcttgcaaaaatatgtatgttattattgcctattttattgtgtaaagtggcctataaagtgttctgttgtttttgttactttgttttgttgttgatgctgtttttaagagacaatgtctctctctatcatccaggctggagtgtggtggagtgatcacgactgactgcagtcttgacctcccaggcttaagtgatcttcccacttcagcctccccaagtcactgggactacaggcgtatgccactgcagtgggctatttttttattttttgtagagacgaggtttcactatcttgcccaggctgatattgaactcctgggctcaagtgattctcctgccttggcctcccgaaatgctgggattataggcatgagccacttcacctggccaatatgtttctcaaataaatcttttaaaaatgtaaatgcctttaaagaacttaaaaaattttttttagaattttttttttcagaattttgatcttttaggatttcaacatttgggattgtggcccaaacccctataggtaagggtttagcacagtacctggcacatgatatgtattaaatatatgatagctaatgccaggtggggtgtcagagccttgccacagagagtgatcggcttgaaggtggtaaaaagaatttaccaacaaaagtataggtttgaaaaggaaagttgtattagatggaaagaacactgtggcagagtgcaatgggcgggcgcttcggcaagagaggactgagggagctgcagtggattttccttaggggtatttatggaccttcaagcaggagcttaaggataatttggaccatattagtcacacaggtaatgataaatgattacatttgtagacattttggtgctgtgacatcagtaagaattgcacagtgagttttgacacgcatgcagtctgaagatctatagaaattctagttacttataagtttttgggaaagaagcctggtaccagatgccagctttagataggaaggacatctaattacttctgaattcctcagataaggagttttgcctccagatggtctgcttgctgaccaccaggtgatctttgctctcctcagctaacattaatattatgtaagttgtagtagagaacacctgcaagtccagtgggctggagcaaatctctgagcaatgcaattcaagaaacattcattgagtatctattgcatgtaagacagtatttgagactggggaaaataaagtaagtacttcaaaataattgcccttaatgtttgtagttattaaaggtgatacctgaactcaatagcttagggatgttggggagggcatattctgggtcttggaaacagtatgcttaaaggcaaagctgaagagagcaatgcttcatttttctggcctggttctgtacttttcaaggtcacttctcaccaccctccatattccagcatagtgacagtgacaatgcaggtgtcactccagtgctttctagcctggctgaagtcacactcacctggaaatctttaaaaacatacaaggtgttcctgagatttcattcatgcaatgtttaccaagtatttattgtatttgaagcactattcttgccactggggagagacagtgataagagctgtattcttatggagcttacattctagtggggagaagtgagcattaaaccagtaaatagaggcagatacggtggctcatgcctgtaatcccagcactttgggggctgaggagggtggatcgcctgaggtcaggagttcaagaccagcctggccaacataatgaaaccccatctttactaaaaatacaaaaaaaaaaaaaaaattaactgggtgttgtaatcccagctactcgagaggctgaggcaggagaatcgtttgaacccgtgaggcagaggttgccatgagccgagatcacgccgttgccctccagcctgggcaacaagagtgaaattccatctcaaaaacaaaaaaacaaaacaaaacaaaaacagtaaataaacacagaaagaagagaaacatcagcaagcactacagtgctatgcagaatattaaaacatagaaatgtgagatcatcatggcagatgggagacaggactagattgcagctctaactcggacggacagagcagtgtgtggaggctcacatcatgaattttagctccagaacgactgcaggaacaaagcaggaatcccaagaggacccacagaccctctgaaggaagcagactgctcctgcaggacccaggagacaccccaaatactgtgagtgcccaaactgcagaagtgggaaagggagaccctcctctccagaacacacaaccccactagggaaaatgaacgtctagtttgtgggaagtttcacaccttaccaggagctgaggcaatttagagaggcaagtgaattatgcagcagaggaacaggaaaggtcctgggaacttgctgggtccccaagcaggcctttcctgcctggccccacagggatccttttgggagggcagccagaggtgtgggggagtggggtgggggatgccacagggagaaggaagtctccagctaaactttgtaacaatttgacctgggcaagaagcctcctggccagaactctggcgagggtgtgaatccggcatccagactccacaggtgagggaggaaccaaacccttttcttttgcagctgggaggcgggtagcctggggcaagttctcaagccctgcttgctcactgcctggaaacagactcgtggctgttagggatggcacagtgggaatgagaatggccctttggattgtgtgggacctgggtgaggcctgtgactgccagctttatcccacttccctgacaacctgcatgactcagcagaggcagccataatccttctaggtacacaactccattgacctgggaacctcgcccccatctccacagcagctgcagcaagacccacccaagcacccaaggagagtctgaggtcagacgtgccttgtcctgcccccccccatgggcctttcctaccctccctggtagctgaagacaaagggaatatactcttgggagttctaggaccccactcactgctggttcctcttcatattaccacagctgatgctctctggaaagcaccaccttccagccggagaccaaccagcacaaaaatagaacattgaatgcaaatggcctaaactctccacttaaaagatacagaactacagaatggataagaaagaactcaccaaccatctgctgccttcaggagactcacctaacacataaggacgcacataaacttaagtaaaggggtggaaaaaggcattgcatgcaaatggacaccaaaagcaagcagggctagctattcttatgtcagaaaaaacaaactttaaagcaacatcagttaaaagagacaaagagggacgttatataatggtaaaaggccttgtccaacaggaaaatatcacaatcctaaacatatatgcacctaacaatggagctcccaaatttataaaacaattactaatagacttaagaaatgagataggcagcaatacaataacagtgggggacttcaatactccactaacagcactagacaggttaccaagacagaaagttgacaaggaaacattggatttaaactataccttggaacaaatggacttaacagctatgtacagaacatttcatccaacaactgcagaatacacattccattcaacagtgcatggaactttctccaggataggccatatgataggccataaaacaagactcaataaatttaagaaaattgaaattatagcaagcactctctcagaccacagtggaataaaactgaaaatcaaccagaaataaacttcaaaaccatgcaaatacatggaaattaaataaccggctcctcaatgagcattgggtcaaaaacgaaatcaaaatggaaattaaaaagttctttgaggagccaaatcaagatggccaaatacgaacagctcccatctgcagctcctagcaagaccaacatagaaggcaggtgacttctgtatttccaactgaggtacccagttcatctcattcagactgattaggcaatgggtgcagcccacagagggcaagcaagagcaggtggggcatcgcctcacctgggaagtgcaagaggctggggacctccctctcctagccaagggaagccatgagggactgtgctgtttgacccagatactatgcttctcccacactttttgcaacccccagaccaggagattcccttgtatgcctgcaccatcaggggcctgggtttcaagtacaaaactaggcagctgttttggcagacaccgagctagctgcaggaagttttttttcataccccaatggcgcctggaaccccagcaagacagaactgttcactcttctggaaagggggctgaagccagggagccaagtggtctcactcagcagttcacactcccacagagcccagtaagctaagaaccactggcgtgatatgcttgctgccagcacagcagtctgaagttgaccggggatgatggagcttggtggggggagggacgtccaccatcactgaggcttgggtaggcagttttcccctcacagtgttaaggaaactgccagaagtttggactgtgcagaattcaccacagcgtggcaaagtggctgtggccagactgcctctctaggttccttctccctggggagggcatctctgaaagaaaggcagcagccccagtcaggggcttaaagataaaactcccacctccctgggacagaaggggtggctgtggttgcagcttcagcagactaaaacgttcctgcctgccagctctgaagagagcagtggatcttccagcacagtgctcgaattatgctaagggacagactgcctcctcaagtggctccctgcctcctgtgcctcctgactgggaaacacctcccagcaggagttggcaaacacctcatacaggagagctctggctggcattaggcaggtgcccctctgggaagaagcttccagaggaaggagcaggcagcagtctttgctgttctgcagcctccactggtgatactcaggcaaacagggtctggagtggacctccagcaaactccagcagacctgcagaagaggggcctgactgttagaaggaaaactaacagacagaaagcaataacatcaacatcaacaaaaaggacacccacacaaaaacaccatccaaagaccatcagcatcaaagattaaaggtagataaatccacaaatatgaggaaaacccagcacaaaaatgctgaaaattccataaaccagaatgcttcttctcctccaaatgatagcaactcctctccagcaagggcacaaaatgggacggagaatgagtttgacaaattggcagaagtaggcttcagaaggtgggtaataacaaactcctctgagctaaaagagcatgttctaacccaatgcaaggaaactaagagccttgataaaagattacaagaactgctaactagaaaagccagttttggcagacaccgagctcgctgcaggaagttttttttcataccccaatggcgcctggaaccccagcaagacagaactgttcactcttctggaaagcaggctgaagccagggagccaagtggtctcactcacataaatgaactgatggaactgagaaacacagcaagagaaattcgtgaagcatacacaggtatcaatagccgaactgatcaagcggaagaaaggatatcagagattgaagatcaacttaatgaaataaagcgtgaaaacaagattagagaaaaaagaatgaaaaggaatgaacaaagcctccaggtaatatgggactatgtgaaaagaccaaacctatgattgattagtatacctgaaagtgacggggagaatggaaccaagttggaaaacactcttcaggatattatccaggagaacatccccaacctagcaagacaggccaacattcaaataaaggaaatgcagagaacaccactgagatactccttgagaagagcaaccccaagacacataatcttcagattctccaaggttgaaatgaaggaaaaaatgctaagagcagccagagagaaaggtcaggtcacctacaaagggaagcccatcagactaacagcagatctctctgcagaaaccctacaagccagaagagtgggggccaatattcaacattcttaaagaagagaattttcaacccagaatttcatatccagccaaactaagctttataagcaaaggagaaataaaatcctttacagataagcaaatgctgagggattttgttaccaccaggcctgccttacaagagctcctgaaggaagcactaactatggaaaggaaaaaccagtcccagccactgcaaaaacacaccaaaacataaagaccaatgacactatgaagaaactgcatcaactattgtgcaaaataactagctagcatcatgatgaaaggatcaaattcacatataacaatattaaccttaaatgtagatgggaaaaatgccccaattaaaagacacagactggcaaattggataaagagtcaagacccatcagtgtgctgtattcaggagacccatctcatgtgcaaagacacaacataggctcaaaataaagggatggaggaatatttaccaagcaaatggaaaaaaaaaaaaaagcaggggttgcaatcctagtctctgataaaatagactttaaaccaaaaaagatcaaaaaagacaaagaagggcattacataatgataaaaggatcaatgcaacaagaagagctaactatcctaaatgtatatgcatgcaatacaggagcacccagattcataaagcaagctcttagagacctacaaagagacttcgactcccacacaataatagtgggaaattttaacatcccactgtcagtattagacagatcaatgaggcagaaaattaacaaggatatgcagcacttgaactcagctctggagcaagtggacctaatagatgtctacagaattctccaccccaaaacaacagaatatacattattctcagtgccacatagcacttattctaaaattgaccacataattagaagtaaaacactcctcagcaaatccaaatgaatggaaatcataacaaacagtctctcagaccacagtgcaatcaaattagaactcaggattaagaaactcactcaaaactccacaactacatggaaactgaacaacctgctcctgaatgactactgggtaaataacaaaattaaggcagaaataaataaataatttgaaaccaatgagaacaaagacacaatgtaccagaatctctgggacacagctacagcagtgttaagagggaaatttatagcactaaatgcccacatcagaaagcgggaaagatctaaaattgacaccctcatatcacaattaagagaactagagaagcaagagcaaacaaattcaaaagttagcagaagacaagaaataactaaaatcagagcagaactgaaggaaatagagacacaaaaaacccttaaaaaaatcaatgaatccaggaactggtttttgaaaaggttaacaaaatagatagactgctagccagactattaaagaagaaaagagagaagaatcaaatacacacaataaaaaatgataaagggtatatcaccactgatctcacagaaataaaaactaccatcagagaatactataaacacctctatgcaaataaactagaaaatctaaaagaaatggataaattcctggacacatacaccctcccaagaattaacaaggaagaagttgaatccctgaatagaccaataacaagttctgaaattgaggcagtaattaatagcctaccaaccaaaaaaaagcccaggaccagatggatttacagctgaattctaccagaggtacaaagaggagctggtaccattccttctgaaaccattccaaacaacagaaaaagacggactcctccctaactcatttttatgaggccagatactaaaacctggcagagacataacaacaaaaaaaaatttcaggccaatatccctgatgaacattgacgcgaaaatcctcaatacagtactggcaaaccaaatccagcagcacatcgaaagcttattcatcacaatcaagttggcttcatccctgggatgcagggctggttcaacatatgcaaatcaataaacataatcagtcacataaacagaactaatgataaaaaccacatgattatttcactagatgcagaaaaggccatcaataaaattcaacacccctccttgccaaaaatactcaataaacaaggtattgatggaacgcatctcaaaataataagagctatatatgacaaactcatagccaatatcatactgaaagggcaaaatctggaagcattccctttgaaaactggcccaaggcaaggatgccctctctcaccactcctattcaacatagtattggaagttgtggccagggtaattaggcaagagaaagaaataaagggtattcatacaggaagaggggaagtcaaattgtctctatttgcagatgacatgattgtatatttagataaccccatcatctcagcccaaaaactccttaagcaacttcagcaaagtcttaggatacaaaatcaatgtgcaaaaaccacaagcattcctagacaccaataatagagagccaaatcatgagtgaactcccattcacaattgctacaaagaacataaaatacctaggaatacaacttacaagggacataaaggacctcttcaagtaaaactacaaaccactgctcaaggaaataagagaggatacaaatggaaaaacattccatgttcatggataggaagaatcaatatagtgaaaatggccctactgcccaaagtaatttatagattcaatgctattcccatcaagctaccattgactttcttcacagaattagaaaaaactactttaaatttcatatggaaccaaaaaagagcccacatagccaagacaattctaagcaaaaagaacaaagctggagatactatgctacctgacttcaaactatactacaaggctactgtaaccaaaacagcatggtactggtaccaaaagagatatatagaccaatggaacaggaccaagacctcagaaataacaccatgcatctacaaccatctgatcttcgacaaacctgacaaaaacaagaaatgggaaaaggattccctatttaataaatggtgctggaaaaactggctagacatatgcagaatgaaactgtaccccttccttacaccttatacaaaaattaactcacaatggattaaagccttaaatgtaaaacctaaaaccataaaaactctagaagaaaacctaggcaataccattcaggacataggcaagggcaaagacttcatgactaaaacaccaaaagcaatgtggcaacaaaagccaaaattgacaaatggcatctaattaaactaaagagcttctgcacagcaaaagaaactatcatcagagtgaacagcaacctatggaatgggagagaaattttgcaatgtatccatctgacaaaggtctaacatccagagtctacaaggaacttaaacaaatttacaagaaaaaacaaccccatcaaaaaataggcaaaggatatgaacagacacttctcaacagaagacatttatgtggccaacaaacatatgaaaaaaagctcacatcactggtcattagagaaacgcaaatcaaaaccacaatgggataccatttcatgtcagaatggtgatcattaaaaagtcaggaaacaacagatgctggagaggatgtggcgaaataggaacacttttacactgttggtgggagtgtaaattagttcaaccattgtggaagacagtgtggtgattcctgaaggatctagaaccagaaataccatttgacccagccatcccattactgggtatatacccaaaggattataaatcattctactataaagacacatgcacacatatgtttattacagcactattcacaatagcaaagacttggaactaacccaaatgtccatcaatgatagactggataaagaaaatgtggcacatatatgccatggaatactatagagccataaaaaaggatgagttcatgtcctttgcagggacatggaggaagctgggaaccatcattctcagcaaactaacacaggaacagaaaatcaaacactgcatgttctgactcataagtgggagatgaacaatgagaatacatggacacacggaggggaacatcacatgccggggcctgtcggtgggtgggggagtagtggaaggatagcattaggagaaatacctaatgtagatgacgggttgatgggtgcagcaaaccactatggcacgtgtatacctatgtaacaaacctgcacattctgcacgtgtcccagaacttaaagtatttaaaaaaaaaaaaaaggaaataggaattcagctttgttcaggaggctctttcctgggatctgctcccagcaggtgaccttactggatatgatccaccacattgggctccatatcctctccatgtctggacaggattcccagaactgcaggcaggatatacctggaggagaggcagaaggtgaggctgggaagttggcctagatcttgaaagtacttggattcaggatcagtctcaggagatagggttggactgtggagcacaagaggagaatatcagttttgtgcaggagcaaaagagttaagactttggatagattttcttttttgccaattcagactcgaggtaatctgctgagagtaaacagacacaggatgttggagagcaatgaagatttacaatttcctaggaaagtaatgagatattaaaaatgattgagtggtattaagcctctgtttgagattagggaccaagtggtccctatcctgagaaggcggaaaatacctcatcaggaaaattttaaattctgacctgctcattctgttgcatttgcttctagcctgtatgtaggggcagaaggagatggcaaaatattcagggcagatggcttctaagctaatactaccaagggaggaggccagctgacttgagagtgccagtcagagagtagtaaaagtggtgttgctgggggtttaggtgaaatatggagtgtgcaaagccatcatgagcttgccagatggtgagaaaatgagagcttgagagactggaggtcttagtgcaggcagagtagtagtgtttggataaacatagaaaactatggtcaggtgtgggatgttggaatttaaaaattttgaggtttagcagttctgagtgatggcaaattatctagaatgtggcaaagaaacttgggcagtaaagcagtcattggaattgatatcaagaaacttgaatctgaggttattagatagtcttagtctaagagtggtggaaaatcactgaaaagttgtaagtaagaagtgatacggtcacagcgattgtttaaaaagatagcccagtttttgaggttgaggatggattagtgagaggtgagagtggaagtgggaagaccaattatgttagtttgggttcttcacaagcagaccccaagacaaggattctcagcaagtagcttatttgctaaataaatgattccaggaaatccaataagtggtggggaagagagagggaaaggcaggagcaacaaagggtgaattattaaacagtttacagctgcaggtaactaaagctgaatcccagcaaggaagagaaacaccgggtgtagaacacatactgctggcttacctcacctgcagtgtgaaggcgtgaagggctggggtatatacacatcagctcctgtcagttactgtttgaggaagctcccagtgggtaatttcttggtacttcctctgccacacacatgagcctagtgggatcttgtggccagagaaacttttgggcaaagaaaaaaaaaaggtagattccagcagatgaaggaagtctggccagcaaggactgagatggtaaaggcaaccagtcatgaatgggcatcaaaaaggatgtgttgcatctgtttgaaggctattatgttaatattagtacagacaagggaagaggtagcttggaagacagttgtgaaaggatttaacaggtgcataaatgctacttttgggaacattacttttatattctccattttgttaaccatgcttgtaagagtgctacatttttgttcctcttttaaagtaaagtgcaagcccaagatattccaagtagataggaataaagtctgatactgttactcctgactcaggtgaaaagtgaaggcagtgttgtccaatagaaatactgtgtgagccacatgaaaaattctttagaagctacatgtaaaaagcagatagaattaattttaatagtacatatttttttactgctataatcaaatatatcaaaatattaccatttcagcatgtaatcatacaaaaaatattgatgaggtattttacgtccttcttggtgctaaggctttaaaatctgatgtgtattttacacttagagtatacatcagtttcagtaagtcacactcaagtgcccaatagccaccatagagtgcaggtctaagggatggtttgtttaagagatgtattcttatttcacagtgtattataaatagccgctacctagtagaaggaaaatagtttgcatttaagtattgaatgttaaagctaaaatggaagaagcaatattagtatagttttgactttctaaagaggagtttcctaatcatggtatttactttgacactgccaaatcaagtggaagatataatttgtaagcttagtgtgggtttctcctagtgacaactagatgactagaatgacaactttcttaacaaactgttttgaccttaaataacgagtggccaggtgcagtggctcacacttataatcccagcactttggaaggctgaggcatgaggattgcttgaacctaagagtttgagaccagcctgagcaacatagtgagaccctatctctaaacaaaacaaaccaaaacaagcaaacaaacaaaaaaacaaaattagtaggccgtcttcctgaaaataagcatttcttactgtttgccagttggacaggaagtattctttaagtttttgacatcagaatcagccttttttatggctcacttcacattcatgtctttcaggcagtatcccagtgttatctcttcctttccttatttcaaaacacaattggcagaaggaatgcagagctccttgtcatatgaatcgcatgtccctttctttctccgtcttcatgatggaagtgagaaatttctatggctaggtaagtgaaataacttaagacaatataatacaatggtctttgagattatgatttaattatcaagggtccagagctattcagatgaatgagatcaaatatttaaaaatactcctatacttaacaaaaatttcatcctctaagatatctttatgacagccacggtcaaatgtggctcatttatgtttttctcctaatttgggcatagggacagcataaaaactaaggcaactcaggccgactgtggcttaaccaaggtaaggagtctttatggccatacccaatttaggcataaaatgttcactactggctaccagaatctcatttttatgagacctttaaggagtgtggggtgggtttccttattttataaataaagcattcttctgaggaagtctagtcactgcttcaagattgactaagaaagtaacctagcaaagtacaaaatagctttggagctttggcttcagaaatacttggatttaaatcttggctttactatttttataagatatggcctcagtcctactagattccgtgtttcagatattccctatttatcataaagagatttttaaaaagtgcttgactcactagatattttgctgtggtatataaatctaaatatgtatgtatatttctataaaaatgggccgactctatgtattctgtttggtaaccttttccatttaatatgttttaaatgttttctggcctggcacagtggctcatgcctgtgatcccagcactttgggaagccaaggcggcaggattggttgagcccaggagttcgagaccagcctgggcaatttatcgagaacacatctctacaaaaatttaaaaaattagccagtcatggtggcatgcattggtggtcccagctacttgggaggctaaagtgggatgattgcttgaacccagtaggtcaaggctgcagtgcgctatgattgcatcactgcactccagcctgggcaagaccctgtctcaaaaaaaaaattgttttaaatgttctccatatcagtaaactaatatgttaacaaacacacatctgtattatcttttttttttttttttttttgagacagggttttgttctgtggctcaggctgtagtgcagtggcatgatcatggttcactgcagcctcaacctcctggctcaagtgaacttcccacctcagcctcccgagtagctgggaccataggcatgtgccaccatgcctggctaattctttggtatttttttcatagagatggggtttcgccatgttgcccagtctggcctcaaactcctgagcttaaacaatctgcctacctcagcttcctgaaatgctgggattaaaagcatgagccaccacacccagcctgtattgtcattttaatggttgcctaatattccattgcaagttattctggggattaaagagacaaaacatatgaatataactggcatctagtaattgttaaaactataaagagaaatggtgctgaaattcatatttcatagagtcaacctgctggttgaccttttcacacctatctttgctagccagccattatcttgcatgcaggcagtctcctcctgccttaaagcaagacctccaagacctctgcaggaattgcttcatacatcaggaccaggaatcctgtgtctcagtcactgtaggcaccagaaagaagatggctcagggacctggatagaagatgtaggtcacaaagattttctctcatggcaaataatagaatattgcagctccttagagaaataaaagatatactgccctgtttcaagatctaggccataccaaaggaaagaaaaacttttgagagatggtttttcagaacagagagttaacttctgtctctgtgaagtctttcatttctagcaccctggaggtgtttgttcccttccttttggaataaaactcagctaatgacctctcactttagtgagattatcagaacttgcagaacattccagattcctatttgaaaatatgtgttcctcttactacattcctagccttaaaatatcctctttaacattccaagaattatttttgtagatgatcttggctgcagttcaaaatactgtagtgtttgctaggctagttcatagtccctctctgaataccattttacagaagtgttctcagctagtctgtgatacaggctatctccggagctcagcttgcatgatccctctggtcatatgggacagggtgtaagagaggaatgttgaggtctattagccattcttcctttttactacatctcctgggaagctataggtgccagtgaaaatagagtctgcggggaaggatagctgcatattaggcatcttatgatgctgtcccaggagcttctccaactaagccaattgatgtctcaatttctcaacagaagtagctgtagatagtgaaagaaagagagcatcagtcttatggccaatgaatgctgttgaagtcctgctatgtgccaaatactgtgctgccattgtaaatagaaaaataaaccaggcagtagtgattcagctattgtggagcttcttaattaatagaaaaaccagtaggtatgaggcaaataatgacaactgtgtttagtgatagaaacaaagaggagattgacctagactagggagtcagggagattttcttaaggaagtgactctgagctgagacttgaatttaggtgggtaacaaagatgggggactggtacttccagcaaaggaagcaccttgtgagaaggccccaggtatgtttgagaactgggagaagttcagcacagctaggggcagagagctagggaaaggaatgaggcaagagatgtgcataggaccaaatcatctagagctttatagtcatattaattcctttgcattttattttaagggtgatgggaagggggaagacaacatatgtattaattttttagggctgccaaaatgccatggactggttggcttaaacaacagaaatttattttcccacagttctggaggctggaagtccaatatcaagatgttgcaggcttggtttctttggaggtctctctccttagcttgcagatggcctccctcttactgcctctttatatggtcttttctctgtgtgtgtgagcccctcacgtctctttcttcttcttataaggatttcttcttagaaggacaccgctcagattggattgagatccctccatgatctcattttaacttagtcacctctttaaaggccttgtctctaaatacagtcatattctgagatactgggctttaacatacaaattttatggaaacataattcagccataacaccatacatgtggcagtagtatagagaattaattggagaggggcaattatgcagacccataggagtcttgtgagagatgatagctaccccatcagggtgtgtgccatgaggaaagagcaaaggcagagtttgagaaacatttccatggaggactgatggcatatggcagtgacgtagagggaggagccaaagatgcctcctaaatttttggtttttgcatctggttagtggtgtggtttgtttaaagaacaatggagaaagagaaacaatggttttggggggaagatgatggttttatttctgctgatgttgagtggttgatgagtaggttgtttactggaggagaaatcagcctctgcaacacacagagctgggatcatacggctcagcctctataacagacaaagttgcttgtcgcctagcccttacgttttacttttcatggaaaaaaaacgtgtagcccttttcaaaaacatgctcttgatatccttagaaattcaaaatttgttaaactagggttccaagttaacacttttatagttaacgttgtggaagatttaacattttttcatagtcagcttgacttgtgactattataatgtgcctaaagaaattgcctgttactgggtagggaacaagatgactgaggtacaaggttggaaagacagactacccgttttgaatttttttcttttttcttttttttcttttgagacagagttttgctcttgttgcccaggctggagtacaatggcgtgatcttggctcactgcaacctccacctcctgggttcaagcaattcccctgcctcagcctcctgagtagctgggattacaggcgcctgccaccacgcccggctaatttttgtatttttagtagaaatggggttttaccacgttggtcaggctggtctcgaactcctgacttaaggtgatctgcccaccctggcctcccaaattgcttgggttacaggcatgagccacctcgcccggcttgaatgttttatcaggtgtaagtataacctgatttaaaaaataaatactacaattaaaaaaaattttataatatttattttattctcatgattttaaaatttaaattttcagagcctgtggtcaaacattagccactgataaaatggcaacaggtaacaaatcatataagaatatgttttcattgttcttactcttgatattcttaaatcgatattactcctaactagtttgatttttaaatacatctacctacttgctcaacaccaaaataagagttcaaaaaaaaaaaagaaaaagaaaaagaaattgcctgttatccttaccctgtttgtgaggataaaaccactcttttatttccttttctgcatgctaagtcttagtaaagaatgcgatcttgctctaaaaacgaagtctgtaaaactctgacgtatgtggtaaaaaaggagtctttctatagcagcagagtcccagggagtagagttgtgtgggagttggtggccctctcagtgagagtgagactgtcaatgatagatggggagcagaaaagcagggtcaggaagcagaatgtgctgtagcccaagtgctgggtcatggtcagtggtgttcttgtgtgccctgggatacttggaggcaggctgcagctaggtcagaggtgggtcaggaaagagctgagttatttctggaaaagaccgaagttttccttgagtcccctgccccacgttgcctcaaaggtcaaggaggtgatgctaccttgctaagaagtagctgtaaggcagcctgggtgacaaggcaaaatcctgtctctacaaaagataaaaaaaattacctgggcttggtggtgcacacctctagacccagatacttgagaggctgaggtgggaggttgaggctgcagtgagccgagattacactactgcactgcagcctgggcaacagagtgagactctgtctcaaaaaaaaaaaaaaaaaaaaaaaaagtagccataaggagaggagttagaatgactagctgtcctggtttgtctggatctggggctgaggggttcctggaatatggggcttttggttttaaaactgggtttcgccatgttggccaggctggctcgaactcctgacctcaggtgatccacccacttcggcgtcctaaagtgctgggattacaggcgtgagccactgtgcccggcctgaaatttatttctaattaaacaagttttccataatattttatgagcaagaaaataaaaattgaaagtggaacattacataagagcaaacagccaatgaaaattaaatggagggtggaggggggaagcattgtccaattagggaaacttttttttttctttattttaaaaataaagacacacacctatgaaggaaacatattttttttcctttttttttttgagacagggtctcactctgtcacctaggctgcagtgcagtggctcgatcttggctcattgtaacctctaactcctggatttaagtgattctcatgcctcagcaacatggtgagaccttatctctacaaaaaatgcaaaaattagccgccgtggtggcgtgcatctgtggttcaaactacttgggagactgaggtggggggatcacttgagccccagaggtggaggttgcagtgagcccagaccacgctactgcaacctagcgtgggtgacaaagcaagactgtctcaaaaaaaaaaagtaatgcacacattggaataatatgcaatccttttttaaaaggtagcagattgattgttctgatatgtgaaaatgcccaacacacacttaaatgttttttgttgttgttttagttttttttgaaacggactttcgctatgttgcttaggctggagtgcagtggcacaatctcagctcactgcaaccctcacctcccgggttaaggaattctcctgcctcagcttcccaagtagctgggattacaggtacccgccaccacacccggctaatttttgcatttttagtagagatgggttttcaccatgttggccaggctggtcttgaactcctgacctcaagtgatccacccgcctcagcctttcaaagttctgggattacaggtgtgagccgctgtgcctggcctcaggtgaacattttttaaaaattaaaaatatttagtgatacacgttactaaaatgtctcaggtaatttggtatgaaaatcatattttatttatttttctttttttccagatcccataagactaatgaaaaccacatttttctaaacaggaaattaactatgcagcatgtatttaaacaattattaggataaaatataagtattattcagagaataagtatagagagtatttgtgtgtggtgtctaaagaaattctatcccaaataaatcacttctcagattatgagacataggtttgaatacattcatatttatttacaatctaattgaatgttcatccccacctttcacccacattgaatatcacctttacatagtttttccattttaatgattattattgaccactagggggagaaacaacaaaagctttgaaatttttgatacatttgaaagattatttaaatgccagctgtgacatgtactaattgtagtgaaatatggattcacagaaggtgctagcatatattcttggttgttggagatctgttgattctatggggtccttcagaaataatgtaacagaaaggtgatgtaacttctccaaagggtgaggaacaaggtgttctatggttgaccagctaaattagttttgttcaacttgtgcctttgcccaaagagtaagtgtgaaaaataaacctgtctaattagaatgaatgatgaaaggattaaatgccttggacttcaaagatgggaaaagtggcagtaaaggaaaaatattaacataatcaaaacaatttccctatgctttgccttaagtgcacttgacaattaatacttaaaattatgggccaggtacagtggttcatgcctgtaatcccagtactttgggaggcctaggtgggatgatcacttgaggctgggagttcaagcccagcctgggcacatagtgagacaccatcttaaaaaacaaaattacggttaaacatatagaacatatttgttaaaaagtgactgaaaattctaaccagctaaaggtgtatttatcttaaactactcaatatgtgagtactttgaactctgttgcttagttagaaaatgtttttgaactattttttattcaagaaattgctgactctgttagttatgagaaaaatgtataaaatatgttaattccacaaataaatgtttaaagtctactcaatgctaggtactcaggagacccaaaactggattagacatatatattttcctgaagaagtttgtagactaaaaaatctattcataaaaacctataaaacaaggtagatgtgagacataccattagagaagaggcactttatgtattaagaaggaaaaaattatttctcttctcttctcttctcttctcttctcttctcttctcttctcttctcttctcttctcttctctttcagaaacagggctttgctctgtcgcccaggctggagtgcagtggtgtgatcacagtgcactgcaacctggaactcctggtctcaagcaatcctcttacctcagccttcaaagtagctaggactacaggtgtgtgccacaatgcttggctaattaaaaaaatttttttttgtagagatgaggtcttgctgtgttgctcgggctagtcttgatctcctgcgctcaagcaatcgtcctgcctcagcttcacacggggctgggattacaggcatgagccaccatgcccggcctacttctattttgatgtgtctataggaggtcggggtaggaggtatgaagactgtaggaatcagagaaggttttgtgaagaatgttgcatttgagcagggtttaaagatattaaggatatagaaatgtggcaattacaggaaaaacatttcaagttcagggagcacagtgagcaaaggcatggaggtaaaatgcaaagatgtataaacttcacaccggcattaaacagaggaaagacctggtgatttaaaaagatttaaatctaatccaacatgtgacataaatttagtttcacctgtgactgtttgtgatggttaattttatgtgtctgggccacagggtacccagatatttggtcaaattttttttgggctatttctatggaaagtttttggataagattaacatacacacacacatttatttagagacagagtcccattctgtcgcccaggttggagtgcagaggcgccatcacggctcactccagcctctacatcccgggttcaagccatccttctgcgtagcccccagagtagctgggactacaggcttgcaccaccacaactggctaattttggtattttttgtagagacgggtttttgccatgttgccgaggctggtctcaaactcctgagctcaagtgatccacccgccttagcctcccaaagtgctgggattacaggtatgagccactgaacctggcccaagatcaacatttatttatttatttattttattttttttgagacagagtctcgctcttttgctgaggctggagtgcagcggcgtgatctcagctcactgcaacctctgcctcctgggttcaagcgattctcctgcctcaggctcccaagtagctgggattacaggcgtgtaccaccatgcctggctaatttttgtgtttttagtcgagaggaggtttcaccatgttggccaggctggtcttgaattcctggcctgaagtgatccacccacctgggcctcccaaaatgctgggattacaggcatgagccatggtgcccgacccaagattgacatttaaatctatagactaagtaaagcagattgccttccataatgtgggtgggcctattcagttgaaagcctgaatagaccaaaaaaaacggaccctcctccaagtaaaagagaattctcctgcttgagacctttgaactaggacatgggcttttcctggttctccagcaacgtgctcctgtttggacttaaactgagacatcagctttgcagattttaaatttgccagcctccataatcacttgggtgaattccctgtaataaatctatctattgatctaccaatcgatccatttatctatccattcatgcatcctattgctgctgtttcttaatactgtttaaaagaaagcatctaataatctaccaacaaatatttattaggtgtcattttaatcccagtgctctgctaaacaatggaaaaaatactagagtagcataaatctatagtgaataaatcccagaactacttcaatgaatatatactgataaaactaatttatttaaaatcaatgtttactttattaatttattattaaagaaaacaattaaaactgtaacttggaggaaagtggaaaaataaattataaccccaacagcctaatacaaccactgttagcatctagtgtattttctttcagtaacttttccctttgtggtatttgatgtatataaaatattagtttatgaaaaatcatgctgtcaattcttttctttaacatgatatcacaggtcagatacagtggctcatgcctgtaatcataacactttgggaggctgaggtggaagggatagcttgagcccaggagatggagttcacagtgagccaagatcatgccactgcactccagcctgtccagcctgggtgacagagcgagactctgttccaaaaaacaacaacaacaacaaccaaccaaccaaccaacccaaacattatatcataaacatttccccatttgtttcataatcttaagaattataatttttaatggctgtacaatacatagtctgcaaacatataatttttataatcatttccttatttttggatatttagattatgcagattttttctttttctttttttcttttttttttttgagacagagtttcacccttttcacccaggctggaatgcaatggtgcgaactcggctcactgcaacctctgcctcccacgttcaagtgattcttctgcctcaattcccaagtagctgggattacaggcgcccaccaccacgcccagctaattttcgtattttcagtagagatggggttccaccatattggccaggctggtctcgaactccgtatctcaggtgatacacccacctctgcctcccaaagtgctgggattacaggcatgagccaccacgcccagccgattttttctgtttttaagatcatcaatataaatatctttattacagtcttctcacagtttgaattatttaagaacaaattcctagaactggtattattaaatcaccaggtatgaagtctatatagtaagtctaaattgtttttcacaaatattataccaatttgtaaggccattgactttgaccatacatttgcctacctagtattcattctcaccttcattaatcaaagacttttttttttttaagtgggaatgtgacttgttataaaagcctcatttcctcagactcccttgcatctaggtacgtccatatgaccgagatgtggtctatgatggttacagggttccgctatgagacacacttttgttttattacataaaaggaacatgctctgctggcacacactttttcctcttttccgctcttctttctgactgcaggtagagcagccttcttgcaactttgaggatgaaagctacaagttaaagtggtggaaaaggaagccagaaggagcttgtgactttcttgaacatctgcaccagctctggtctcctttctctggaattcttgttacatgaataaattaatatgtgtttggttaagcaactgtagtcatatttctgctgcatgaaatcaaaggaaaacctaatagtaacatatatgcatagttattctccacaataatgaatattgtcactacaattagtggggatggggcactgagttggtactcttgattgcaaataacaaaaaacctaagctggtttaaagaaaaaagggaattcactggtccatgtactgggggaggtagaggggttgaattcaggcttcacgaagtagcatcagtaacacttttaggtctgacctctttctccctttccctttttcctctctctccctttcacatatctcctttgctttcctctgtgtgttgatctcttctctcctacaaaaaaatggacttcttccacgcaactggagaaattgaccatgttggttgaatgtcaggagaaagaaagaactttacagttttgatcatatcagtccttgggaaggactctgattgaccaggcctgtttcacccattcttggatgtgttcatccaagaagggacggggaatagaacaactgtgattatcatccccaccaggatcactcaaatacagaagaggcaagtcctcaaagagaaagtgaggtgttgacaccataacatagctgctgaaaggctaaaacaacccatcatcaataaccattttttactaataaaatgtttcttattgttattttaatttacctttattttaagttgaagacttttttgtttgttaatttaatttaatttaaaaaatttgaaaattccctctcctaacattgacaaccagaatatgcttatacctgacaaattgggtagttgaatagtctctttattttgaacatgatcccaattttgggcttgtaatctaatattctgtaactggaaatgccatgcacaagggagagaaaatatatgttctttatgatgtctgtgtatgtataatgttctaaaggtcctaaatttagtgcgaacagtggcaatggtgtaagacataaatttaatctgtagttgtatttgagtcatgtaatatatttagtatagagagattaaaaatatagtagattccctttctagaagttaactaaattgattttaatatattactttgtgagggctgggggcagtggctcatgcctgtaatcccaagcactttgggaggccaaaagcgggcagatcacctgaggtcaggagttcgagaccagcctggccaacacagcaaaaccctgtttctactaaaaatacaaaaattagccaggtgtggtggcgggcgcctgtaatcccagctgctcaggaagctgaggcaggagaattacttgaactgggaaggtggaagttgcagtgagttgagatcgtgtcattgcactccagcctgggcgacacaacgagactctgtatcaaaaaaaaaaaaaaaaaagaaagaaagaaagaaagaaagaaagaaagaaagaaagaaagaaagaaatatatactactttgggagaaagtttctttaagtattacactggtatattggcattattgatttttcccaaagactttgaattattcaaaatgagattcaaaatcctatttaggatttaagctttagactaaggcttaaaagtaagacatattgctttttccccccatctaaagtagtctagaggatcttttggtaaataatatgaatattttattaaatattttaaaatttactaaatattcattcatttggtgctcagagccattatttcatatgttgttatggtgcacatgggatcttatgattttggagagcgggacagtggctgttgattctttcattctttacttctagctttggtgtaagggtagttctagggtattgcatgaggcaaatggatgagaaaccaagtcatcattatgcatagctttgcctacatcattccaacaaactgaatttaaatgccctttgaaagtgggaagattgagacctaaaaataagtaaggtattgatcataccatgtaccctatatattaaatcggctagatttcccttttcttttcagaaaaggggcaggtgatggaagtaaatgactatcttttctctgccctcatatcttcttctgtgtctggctgctccagaccagctgccacctgcagttatacaccctgatgtgctactggttgctgagaaagaggcttttaaaaaaaatctcttagagtataaataaaataacaggtcaaaaatgcctgagacatactggtctgctgataaatattaattacacctggatttacataatagacgcttgttcagggtagtttgcaaacttgccatttaggcaactgcattttatatggagcccagaggaaatgacatttaccttccaatggatacttggagtcctaagtaggggctatatgcagctgaaaacatcctgatagccatgtgatttcatgcttctgtaccttgcttatgtttttctcacctgcctggaattctgtattttgttttttgggacttagcatgagtttatattctcttggaagtgctttctgaccattctcatttcgccatgacctaggtgcactttgtttatactctcagagcatcttgtgcataatcatatacttgagttctaatataattgattttcctacctgcctatcccagtgtaatttcagggcgggctgcaaccatgttttatttatctttgaaacattatggcgtaacaaaatactaggatcagtgggtactcagtgtctgttgaaaggaggaagcagttgaattttatctatggagtcttctcatctccctccttgttttccttctcttttgtggtaccccaccctgtcttaccccatctcacgacttttgtgccttcgttcattctccttctggcttgctgatggcttctatttcctgctcttgtctgagcttggaaataagtttatttacatcataaattacaaaccactagagtgagaaaagtgttgatcatccattcaaaagtgttgaatccttcaataattagcagagtacttttcacacataggggttgatatggtttgtctgtgtccccacccaaatctcattttgaattcccacatgatgtgggagggacccagtgggaagtaattgaatcatgggggcaggtctttcccgtgctgttcttgtgatagtgaataagtctcatgagatctgatgactttataaggcagagtttccctgcacaagctctctctttgcctgctgccatccaggtaagttgtcacttgctcctccttgtcttctgccatgattgtgtggcttccctagccttgtggaaccgtaagtctaataaaccctttttcctgtatacattacccagtcttgggtatgtctttatcagcagcatgaaaattaactaatacaggggtttatttagactttaaaatatgttgctttttttttttttttgagatggagtcttgctctgtcactcaggctggagtgcaggggggcaatctctgctcactgcaacctctacctcctgggttcaagcagttctcctgcctcagcctcccaagtagagtagctgggtctacaggcatgtgccaccatgcctggctaatttttgtatttttagtagagatagggttttaccatgttggccagccttgtctcaaactcctgacctcaaatgatctgcctgcctcagccttccaaagtgttgggattacaggcataagccaccatgcctggcaatatctatctagttttctatctagttataaaagtaatacttattcactgtagagaatttttaaaaatacagaatgtcatcaatcataaaaaatcacttatctatcacctatagataaccattaccaatatttcagtacattgatacgtatactcttttgttcccccgcaggcataagccaacatgggtggccaatgtatatacacttttatttatttttctcagcacaaatacaatgatacattgacacatataacagttcttttccatgcatatatactcttttcctttttgcaaaattgggatcatactgtataaaatcttttatcctactttttgtatttaacatgtatcatgagctttttatcattatgtaagcattcttttaaaatgtcatttatgtaatgcgtttcttatttatggatatttagatcatttccagtttttccttttataaaacatgtctgtgataaaaattctgtgcctaaatgatttctttaagataaattcctagaattatttgaccactctgtgtgaatattttaaggtcttttgattcaatagccaaaccaacttccagaaatattatatcacttttccattcatccacccactagcaaatatatatgtattttttttttgagaaaaaaaagcatatatttttttgagatggagtttcactcttgttgcccaggctggagtgcaatggtgagatcttggctcactgcatgcaaccttcatctcctgggttcaagcgattctcctgcctcagcctcctgagtaaccgggattacaggcgccctccaccacacctggttaatttttgtatttttagtagagacggggtttcaccgttttaaccaggctggtcttgaacttctgacctcaggtgatccgcctgcctcagcctcccaaagtgcagggattacaggcataagccaccgaacctggccagcaaatatttttgaatcctttactatgtgtttggctctaggagctaggattataatggataataatacactcaaggtccttgctctcaaaagactgacattctactgaggaagacagacaataaacaaataagtgacaacataaaagaataatagattgttgtcgctgctctgaaggaagccctagtagagtaggactgtactttggttaaagtggtgagagaaggcttttctgacagagttaatttaatccgaaatatgaacactagccatggaagtggagaggatcatctgctgcgaagggcagaatggcaagaaatgaggtcgagagggctatgacgccaaaggtccaaatcatggtcctgtgttaggtgacagggagctattgaatataccaatcatggcaatgtgtttataggcatcaggaggtccacgcttaatcacttttggtgaatgtctgcattttaacagacgtttctagaaataccctccttaactctaaagaatgcccccactggtggaattttgggcatcacagttggtggacatttcactgcctcttaggtcacattttatatggaggtggcctgcatttcctacattcgagggtttcttctcaggctatgtcctcttccatcaatgcccacgagtctacacagatattttggacatatacagcaacaatacaaggatcaaggctcattttcttgccttctcaattaaggttaataaaacctgcttagccatgattttcttggattgattttatatctccttagcagtggaattatttaagatgaatttttaaatatttaatctaaatatgcttgccacatttgcactctgtatttctaatatacatatactatattatatatattataataattatattacttaatattacatattatatggaattatatattatatatagagataatatatgtagagaaatatatacggacaatgaaaataatcttttgtataaagaattaagaagaaattaatttccaaaaactttgtagtattatctgagatacatattgagattcaacagcaggagctgtttctgaatctaaattcttggctttgattagtttgtgtttatattaggagtcaggatctgtattagctttcagatttatttttgagtattttgtgcattgatattttgctgaacacattcagatttatacatatttaaacatgaaaagctttttattttggtagtatagattttacttatttctttcccatcaaaaagaaaatgatcctctattagaattcagattttttcaagaccattctgaaatcaaacatgattatggtgaggaaagcattctttcaattctttgtctaaaaaagcatgtctgtaccgtactattctgattgttcttttgaaaagacatattattataagcaatcaaaacaaaatttgtcttgtataacataaaaggaaatcaacaaatatctactgagtgtctacagtgtaccaggacctgagtagtcactgtgaggacaattgagaagtgcagtatgtgatccctgccctataattgctgacaacctaacaggggagatgaaacacagggatgggggagcccttggacactgacatctatagcgcacctgctgtggcctaggaattgtgctaggtacttccacataacttatctcatgcattgctgagctcaacatcatcccctaaagtcttcagtattctccttcccactctatccagtcatctaggcttcaggtcatccttagtccttgccaccctaacttacctcccacatccaatcaagatgaattttcattcctggatccttccagtggtcctttgactggtctcattgcctctattctcttcccttagcagctcatcctccttccatattgtggacaaagtgaactgtcaaaaataaaaatatgattagattaattacaattcttttggggtgcaaacaacataactcatttaagcaaacgtgagcatttattattatgactgcagcagtgattcttggggtcccaagagtaggttgcagtggggttggatgaacagaatggactgagactgcagtccttcctttctaactcttgtctttgctcttctttaaatgtttactttatttcttactgcagatcaactttttcttacttctggtctatgtggcagaaaatgacagccagactgagcctggacttgatcagtccccattctaaattcctcaggggaaggcgtcatttgacgagcttgggtcaggtgtcacccctggatcaatcgccaatggcaatcaatggcaatcacagttaccttgaaggaaaaaacaactgaaacgttgttattgaaagggagaaggagcagttctcaggaaatgcattgctaggcagacaaatcagtaggcatttcttggagaggctgagcatttgagttgactggagtatgtgattgaattagagggaaaaataaataaggttgcagggatgatagtttggaactaaattttcaagaatctttatgtaaagctaagaatgtgaagttcatagatatttggaagttactgcagtttttaaagagagtaacatgatgaagcactatttaggataatctggaggcaaagtaaatagattagaattgagagacactggagcagagcccatctaggaagaaattacaagagtcagatataagagcactggaaaaacgagtaaaaatattaggaaggacaggattacttggacataggtaggttttttgtcttgttttttgttttgtttttgttttttttgagacagggtcttgacctgttgtccatgctgaaatgcagtggtatgatcatggcttgctgcaaccttaaaatcctgggctcaagtgatcctcttgcctcagcctccccagtaggtgggattacaggcacacaccaccacacccggctaattgtaaaagttttcctttgtagagacagggtcttgctctgttgaccagtctggcttcaaactcctggcctcaagtgattcttctgccttggcctcccgaagtgctcgagtggtgggattacaggtgtgaaccaccacacctggctgacttctgttttttaatctatgtgaaatttttgtgactatcatactgctatgggatacaacacaaaacagaccatatgtttcacagttcataaggctgaaaccatgtagttcaaacaatgctatcatggttgttagaatttctaattttctttcctctgggaaataacagccagggttttttttttttccctgtctcccaccatccccaccccaccgtatcatatattgggaagatattattagaaataggaatgaagccacaaaattctggggactggttaggcagagggcagggagaatgacgaaaccatgaccgattgttttcaattcaagagtggagttcctgtaacaaggataaagctaatatcattaactgtgagtattggtgagtcatttttaaggaagatctgtcaagtttttatagcaatttctgtgtaaagtttattttaacatttatcacattgcattttacttatctctccatgtggccactcagcattgggctgtcagcttctctagggcagacattcttgcttattaatttttatatccatggtgcttggcacaatgcttgacttgttataagtgcccaacaaatgctgaatatcccccatttgattataggcttttgaaggtagggtctatgcttctccatataacttccaaagcatgttgaacaaaaatgctttgaattgaacaaaaattactaatatatgagttcccaacctttcccctgtcttgattcttttggatttttatgctaagaatcaagagcaaaaagagtgtaagagaaaaacaagaaggctacgtttgggtgaagagttttctgggggcttgtatagaagaagtgagggactaccggggatgtgtgaggacagtggatgggacagcatagaaagggattttaagaagtgttgatgtgaactgtgtgctttcttcttggtgttcggacaacacaagtaaaggacttgctttatttttgaactcctgtttgttcttggactgtgtgcctttgatgatgccattctgggatagaactataagggtcacaggtacatgagctttatatttatttagtaaatatctgtgaaaggaaggagaagaaaagagagctaaagagagaagacaatgagggctggatgaaggaagaaagaaatgaagggagtacattaatgtcagatatcatagaggagatatgtgaatctaaaccatatacttccatttccatttagaaaccaatatggttcatctgaattattattaattttctctgaaattggtgagatttccaattagatataaggagctgggtgagtttcaagtgagaataaaaagcactgggacaagctcattttgcattaagaaattcagctgatcttttattacaaataaaatgaacactgaatagtaattttcattaaagaatgaaagcatttaactacttacaaatacttcaattattagttttcaaaatgtattttatagtagagatcaatactttttgtccaaggaaattacccgcttaaaatctagtatttttatatagaaacatcattcctgggataaattaaaaactatttttttctaaataatatacatggatgttgagactaatgtggtatgctatattggaaatatcttcacaaactttaaaatagaacataaaaaatattcaaagggcaaacgaaataaaataaatttcaggaatgaatctgtttttaaggtcatgtataactactattattacataatataattctgaataaataaatcgtgtgtgcatgaacaagctagaagcttattttaagggtttcttgaggctttctcacatttaaaaaagtcaggctattgattatagaatcatagcattttagaacagaaaagggccttggagatggccttgttcaaccctttcattttacaggtgactaaagtatgttatttgggtagcagcaaactaaaaagtcttcaacgatggttctctattgcggtaacaaccactctggcctaactattccttcaccagatcactgcaactcaactgcaggaacacagaaagaacaaaagcgacaacatcaagcctccgggtttgctggaattcattaatgacatcccttcctgctgagctaacaaaaccttgaaccagcaagcagttgtcttcttaaattgagcttgccaactgtgttataatggtggatttagagacactaggtgactccacttgagcagttgtggtggccagagaagaattattcttatcctcatgaaacgtagcccaaacaatcattaccagttggttctagggaactgcttttagtgagactattgttgtcagtattgttgagttggggtaaaaagaaataaggttacagggatgatagtttgaggccaaattttcaagaatcttatgtgatgttaaagattttgaagattgtcctaaagacatttgggagttactgcagtttttttaaaagggagtgatatgataaaacactatttagggtaattcaactggagatgaagtagacagattagaattgggatactctgggaggatagaaggtacaacagaacaagcaggtgtgccccactgaatcatctatacatttagaaaggtaagacatatgtttatctcataaaacaaatgagtgggccgggtgcagtggctcacacctgtaatcccagcactttgggaggcagaggtgggtggatcactggaggttgggagttcgagaccaccctggtcaacatggtgaaaccccgtctctactaaaaatacaaaaattagctgggcatggtggcagactcctgtaatcccagctactcagtaggctgaggcaggagaatcgcttgaacccgggagactggggttgcagtgagcggaaatcatgccactgcactccagcctgggcgccagaatgagacactgtctcaaaaagcaagcaaacaaaaaccaaatgagtgaagatagttctatgagcaaagcagcttttaaatacctgctaaagtgtgatttcccttgtgaattttcttatgtccctgtattagtcagtcctcgcattgctataaagaaatgccagagactgggtaatttataagaaaagacatttaattggctcatggttctgcaggctgtagaggaagcatagtggcatctgcttctggggaggcctcaggaagcttctaatcacagtagaaggcaaagtggagcaggtatgtcacatggtgaaagcaggaacaagggaacaaggtgggagatgctacacacatttaaacaaccacatctcatgagaactcactatcatgaggacagtatcaaggaggatggtgctaaaccattcatgagaaatctgctcctatgatccaatcaccccccaccaggccccactttcaacactggagattacatttcaatatgaaatttggatgggcacacaaaaataagctatatcagccctcttcccgactccaccactgtaattaatcaagcaatattgcaatgattaatttacatgtctctctagtttaccagtaataagctctttgaaggtaggcatagtcttattcctctttgtatatctaccaccccataaatattacatagattgttttgaattgaatatattgttattgtttggtcttgtaggtcctcatcatcaatctctaaatgaagttacttgaagcaattcttgaaaccataataataatgtctccagaattggtggattcttggtctcactgacttcaagaatgaagccacggaccctcgcggtgagtgttacagttcttaaaagcggcgtgtccggagtttgttccttctgatgttcggacatgttcagagtttcttccttctggtgggttcgcggtctcactggcttccggagtgaagctgcagaccttctccctgagtgttacaactcttaaggcggtggcacatctgaagttgttcattcctcctgggggttcgtggtctcgctggcctcaggagtgaagctgcagaccttcaccatgagtgttacaactcataaaggcggggaggacccaaagagtgaagagcagcaagatttattgcaaagagggaaagaacaaagctcccacactgtgaaagaggacccgaatacattcccattgctggctccagcagcctgctttcattcccttatctggccccacccacatcctgctgaatggtccattttacagagagctgattgtctgttttacagagagctgattggtctgttttgacagggtgctgattggtgcatttacaatccctgagctagacacaaaagttctccaagtccccactagattagctagacacagagcactgattggtgcattcacaaaccctgagctagacacagggtgctgattggtgcatttacaaaccttgggctagacacagagtactgattggtgcgtttacaatccctgaggtaaacagaaatgttcgccaagtccccaccagattagccagatacagagtgctgattggtgcattcacaaaccttgagctagacacagagtgctgattggtgtatttacaatcccttagctagacataaaggttctccaagtccccactacactcaggagcccagctggcttcacctagtggatcctgccctggggccacaggcggagctgccggccagtatcggcatgcacccgcactcctcagcccttgggggtttgatgggacggggcgctgcagtgcagatggtggcgcccattggggaggcttgggccgcacaggagcccatggcggggagccggggggaaggctcaggcatggcaggctgcaggtcccaagccctgccccacagggaggcagcaaaggtccagcgagaattcgagtgcaccacgggcgggccggcactgctgggggacccggcgcaccctccaagctgctggcccagttactgagcccttactgccggaggctggcggcgccggccggctgctccgagtgcggggccgccgagcccacgcccacccggagctcgcgctggcccgcaagcaccgcgtgcagccccggttcccgcctgcgcctctcccaccaaacctccacgcaagctgagggagccggctcaggctttggccagcacagaaaggggctcccacagtgcagtggcgggctgaagggctcctgaagcgtgaccagagtgggcgctgacgccgaggaggcgcctagagcgagcgagggctgccagtacactgtcacctctaaataagataaacatttgaagagtgcctttaatgttcaaggaattgtgaaagacacaaagttgaacatgacatggtatctgctttggagaggctcatagctaaagaagtgtattggtttgctagggctgctgtaacaaaataccacagactgggtggcttaaatgaccacacagaaatttatttcctcacagttctggaggctggaagtccaagaccaaggtgctagctggattggtttcttctaagggctctcttcctggcttgcaggtggccaccttctcactgtgtcctcctgtggcctttcctccgtgcatatgcctccccgttatctccttgtatgtccagatttcctcttcttataagaagcagtaagattgaattagggcccaccctaaagggcccaccctagtggcctcattttaacttaatcacttcttcaaaggctctatctccaattgcagtcacatcctgagtttctgggggttagggcttcaacatacgaatttgccggggggacacaattgagcttataaaaggaaggagactataataaacagtttaataccaatcagctttgatgggaggcatctgggaaataaatagttcagaacagtaaactttgcagcagaaactggagatgaaagtttgagactttaatggaatttaataatcaatgcattctcttgaagtcattttacaaaaatcaatataaattttcaaataccttatttggaaagccactgtgtaactgggccagatggtctgacatgaactatactcatttatagtcttttaaggtaaaatgtcctccatgggtatacagtgtagtagtttactggcactgattttggaattacattgttccggtttgagccatggttctgacaggtcctggtctctgtcgtttatcctcaggcaaatggcttattctcactaagtttctttccttgtctgtaaaataggggtaattctagttcctatttcatagggtggttatgaggattacattaacatataggctttgtacatagtaaatggtcaataaattgtagctctgttcacaggctgttagtggcttgaattcctcagacagattctttattaaacataattattctttctgctcacccctgaggcttaacccagtttttcatgcagtattatttatttatttattatttatttatttattatttatttctgttgcccaggctggagtgcagtggggccactgtactcactgcagccttgaattcctgaactaaagggaccctgtcccctcagcctcctgaaatgctgggattacaggcatgagccactgtgcgtggcctccagtgctattttattaatcttaagagatgtatccgtgacagttctaacttgagaaccttagatagagatagtataacataaattcaaagcattactatagattatggtaaattttaatggttctcatgaaaacaataaggatttctttatcaatctgagagaaattctgttgggaaggtattatagcattaaccactctgtactgtactgtgtatatgtttgcctccttggttagactgtgaattcttagagaaaagaaaacatgccatgtttatctttgcactgtgatgcaacgatggtgtagtggttaagagcatggtctttggagccagccttcttaggttgataccctggtctatatccagacttttgggattcatactttacttgtttgtgtgtccttgggcaagatacttaaccacttgagaactcactcacctgtgaagtagaaatagtaatgatgtctacatacttcataaaaacttctatgaggactaaatgaactagtatatgtaaagcttaaaatagtacttggtatgtagcaagcattcagtagattttcaccatcattagtatagcacatagcttagctgtgcttaataaacatgtgttaagtgaatgaataacacggattctgagtagtaagaagttggtggctcagtgctagctggcattctatagctaagcatgcaaccaaaatcgtataatgaaggaccactgtcagggaacagtggcttatgataataatgtgctagcaaaacctggaggtaagtttcctgtaactttgtagaatgtgtgctaatgctgatgagtccaacactgtgccacacattttccagcaaataatgaatactttttgagggggaaaaatccctgggaaaataaaatagcttcaggaagccatgaaactcttgctttatttttgacttggcatagaaggtggggcacataccttgttctgaaccgaagaaagtgtagtgaaaatattatttcatatttctcttttgtctttggtatagcagagtcttctggtgcccatacaatactccttctctctttttccttgccaacagtcgtgattttatatccacccctcaccttcctgttacagataaatcctgatttgtctaagtcaattgtggacacagacacaactccaaacacacacacacacacgtgcatgtgcatgagtgcacgcgagtctgatttaggaaggagcataagacacaattctggccaaagaaaaatgaggataaatctgtgatgagggcttctggaaaagattttcttactcttaaaaagagacacgcaggaggaggcaacctcattttctgctgcacattgccacgtcaggatgaaacgtttggaattgtgacagcatcttgtaagtatgagggggagctagctatcaaaatgtaaacaaattttctctttagaatcagtgagatttaatctacgacagaaatttaagcttaggtgtgaaatgactttctctatgtctcctatgaagtttgtggttatctcattattacattctagatttctacactttccatctagtgcattcaaatatgttgacaatttttagagttacaactatgtactgttgcttactttatatctgtgatttttgatccttgtttccagaaacatcttcaatcttatttttttataacagttttgtcaaaatctaattcacatactatgcaattcgtcaatttaaactgtacagctcaatggtttttagtatattcacagaattaagcattcctcaccacaatcgcggttagaatattttcatcaccccccaaagaaactttgtaaccgttagcagtccttccgcatttatacccactccctctagtcttaggcagccactaatttactttctgtctctatagatttacttattctggacatttcatttaaatggaatcctgtatggtcttttatgactggcttctttcacttggcatatgaaagattcatccatgttgcagtatgtatcagtatagcatgtcttctcttgctgaataatattatattgtatggatatgccatattttatttatccatttaaacagctgatggacatttgagttgtttccattttttggctattatgaataatgctgccactgatgtacttgtaccttttttttttttttttttttttgagacagagtctctctctgtcaccaggctggagtgcagtggcgcaatcttggctgactgcaacctccgcctcctgggttcaagtgaattctcctgcctcagcctcctgagtagcttggactaccggtgcatgctaccactcccagctaatttttgtactttttactagagacggggtttcaccatgttggccaggatggtctccatctcttgacctcgtgatccgccctcctcggcctcccaaagtgctgggattacaggcgtaaaccaccgtgcccagccacttgtatatatttatgtacacattttttgtgtggctatatgttttcatttctcttgagtgtataccaggagtgaagttgctgggtcacatactaactctatgtttaaccttttgagaaactgtcagatattctttaaagtggctgcaccattttgtatttccatcagcagaatataagggaaccatttctctacgttccctccaatactcatcatctttcttttggattatagccaccttagtggtatctcaacatagttttgatttgcatttctctgatggctaatgatgttgagcatgtttaatgtgcttattggccatttgtgtatcttctttggaaaactttctattcatatttttttaattaataaactttatttttagagcagtttatttaggtttatcgaaaacatgagcagaaagtacagaattcccctatattcccttaccactcccccagtccacacacagtttcctctattattattttttgagacggaattttgctcttgttgcccaggctggagtgcaatggcgcgatcttggcttaccacaacctccgcctcccaggttcaagcgattctcctgcctcagcccccctagtagctgggattacaggcatgttccactacgcctgactaattttgtgtttttagtagagatggggtttctccatgttggtcaagctggtctcgaactctcgacctcaggtgatccgcccaccttggcctcccaaagtgttgggattacaggcatgagccaccgtgcccagccagtttcctctattattaacatcttgaattagtctgatacatttgttataattgatgagccaatgttggcacattattattattacctaaaatccatagtttacattagggttcactctacattgtacattctgagggttttggcaaagttataatgacatgcagtcaccactacagtatcatacagagtcgtttcactgccccaaatatcccctgtgttccacgtatccatccttcccacttcccctttcccccaaaaccctggcagccattaatctttttactgtctccatagttttgccaatttcagaatgtcatgaagttggaattgtatggtatatagtcttttctaattggcttctttcacttaaatatggattgatggttcctcaatgtctttttatgacttgatagttcatttctctttattgttgaataatactttatcgtatggatgtaccacagtttatttatcctttcatctattggatggcattgtggttgcttttgagttttggcaaatatgaataagtggctgtaaacatttgtgggcggggttttgtgtataaatatattttcaattcatttgggtaaatgaatgcagtttctggattatatggtaagagtgtgtttagttttgtaagaaactgccaaactgtcttccagagtggcaatactattttgtattctcaccagtaatgaatgagagttctttttgctccttttgtctattttttaaattgggttatctgtctttttattactgacttgtaagagttctttatatattctagatataagtccctcattgggtgcatgatttgcagaatttctccccatcctgtgggttgtctttattttcttgttggtgtcctttgaagcacaaattaaaatttttataaagtccagtttatgtcttttttcttttgttactagttctcttagtgtcttgtctaaaaagcctttgcctaacccaaggtcatgattcattcctatgaatgattcttcaaagagttttatagttttagctgttttatccatttaaaattaacttttatatgtgatgtaagttcggagtccagctacactttttgtatagggataatcctgctgtcccagcaccatttgttggaaagagtactctttcccccattgaattggcacttttattgaaattaactggccataaaaatgaaggctgattcttgggcactcaattctgttttagtgatctgcatttgtatcctcatgccagtactacactgtcttgattaccgtagctgtgaaggaaaatttgaaaacagaaagtgtgagtcctccaactttgttcttttcttcgagattgttttgtctattctgggtcccttgtattttcatatgaattttaggattggcttatttttttcttttcttttctttctcttttttttttttttttttttttttgagacagactcttgctctgtcacccaggctggactgctatggtacaatctcagctcactgcaacctctgccttacaggttcaagcgattctcctgagtcagcctcctgagtagctgggattacaggcgtgcatcagcatgcccggctaatttttgtatttttagtagagatggggtttcaccatgatggccagactggtctcgaactcctgacctcagatgatctgcccactttgtcctcccaaagtgctgggattacaggtgtgagccactgcacctggccggtggaattgtttccttaatttcatttttgaattgtttattgctagtgtacagaaatacagttgatttgtgtatatagatcttatatgctgcaaccatgctgaactggtttattatttctaatagttttagtagattcattctgtttttctacatatgagataatattatctggaaatagaggtaattttactttttcctttccaatctagattatttttatttcattttcttgcctacttgacctggctagaacctccagtacaatgttaaatggaagtggcaagagtggattttttttttttttttttagatgagggtctagctccgtcacctaggctgtagtgcagtggcatgatctcggctcaccacagccttgaccaccagggctcaagcaatcctcccacctcagcctcctgagtagctgggaccacaggtgtgcaccaccatgccagactaattttttgtatttttgtagaaacagggttttgccgtgttgcccagtctggtcttgaactcctgggctcaagtgatctgcctgccttggcctcccaaagtgctgggattacaagcatgagccaccgcgcccagcctgagagtggacatttttgtcttgctcctgatcttagggaaatagttttcagtcttttactattaagtatgatgttagctgtggttttttttttttaaatagatgccctttatcaggagtgtctaaggagaagagagacagcaacaagcaatggaaaaatagatgttgatgggtatctcatagaaggttctgtgccctaccttttgatcaaagccccaaggacaggtaaaaacctgtgactgtctaaggcattcaaaaacagagccagattgtgccgtgctccatacaggtaaaatcagagttcaaaatagaaactgggctgggtgcagtggttcacacctgtaatcccagcactttgggaggccaaggtgggaagattgcttgagcccaggagtttaagaccagcctgggcaacacagagagaccctgcctgtacaaaaaatttaaaaaaaaatccaggcatggtggtgtgtacctgtggtctcagctacctgggaggctaaggtgggaggatcgcttgagcccaggaggtccaggctgcagtgagctgtattcacaccactgcactccagcctgtgtgacagagcaggaacctgtctcaaaaaacaaacaataaaaaaaaatgaatttaagttgtaggaaaataaagttacattttttgctcacacaaattgtaagctgaaactcataatcactgtgttattaatcaccaaataacttttacatcgggttttttttcactcataagtggtaatggatatgtataataataatttccagtaacataatctttctggatgcctgtcctgctcagtatgaatcaattctgtttcttagtgaatacgtttttaaaatgctaaaacattttttggaattagcattgattttttaagggaatctcctgtggctagagcagcgtatctttaattgatttggagttagagaataatacatttatagaaaagacaatcacattttacataaaaatcaatgccattttgccatgtaaaggcttctgggaagctgactgaagatgtgaatcttgaggcattcccttttatacgttcaaatgaaacatttattcattactttcttattttgtaggactgttatgtaatcagaagcaggatttcatgcaaagtgtggacatacattatgattttcctaattaccacactgcattttaatagaaaaaaacccatcaaaattattgaatttagccctggaattcaaaacaaaaactatttaaaataatatttttcctacgttttcaaaaattttcccattttgagaagcctacattatcatatttctttgagcgcttactttacttctttttcttcttgaaaacttagaaaagcattgatactgggtattgttttttactttataaccagtggttctcaatcctggctatacattagagtcaagtgggttgcttttatttatttatttacattgttttagtttttatttatttatttacattgttttgttttttatttacatgattgttttttagagacaggttcttgctctatcacccaggctggagtgcagtggtacaatcatagctcactgcaacctcaaattcctgggctcaagtgatcctcctgcctcagcttcctcagtagctgggactacaggcatgtgccgtcactgggttgcttttaaaaaataacaacacgcgggccttaggcacccctgggggtgagagtttgtcactgatattctttaaaagctccccagtaattttagcatacagctaggttgagactgttatttaaatgatcactagaaatggtgaattttatggtatgtaaattatacctcaataaaactgtgtaaaacaataatcaccaacaggtatctaaagcctcactgacataaagtgtctcacccatatgactatcaggtgccaacaggcccagtttccccaggatcgagaggtttccccacacgagggacttgcagtgctataaaactgggaaaatcctgggaaaactggaagaggtggtcacactgtagtatggaagagatggcttttctagatagaaaagaacatttttcccttcttggtaaaggttatttgaggagaaacagaggtggttctagcttcttgcccttctcaaagacactcattgtagccacttcttgacctcatactcactcatgaacaccttgtcctttgacttcaaactccaccacctcactgaaattaccctcttggagatgaccaatgactttgtaatcaccaaatccagtgactcatcagtgtcttctgctgatgcctttaccccttccttcttgctttctgtggcatagtattagagtgtttttcctactctccttgaaccattgctattgcctttgttagctctgttttttttttgttgtctaggtgtaggcatttttcatggttctgttgtcggctcttttcttgcctatatatacttatgatttcacctgtttcctttctgcatagattcctattgtcagtagctgttttcatgaccaggacagcctttccctctcagtatctatggccctaatggggtaatagaagagagaaagacacacacctgcttgcacaatcttagaaaactttattgtcttcatagtgagtcctgacattatagggggcagatatgtaacgtgacacatcaagacaaatttatagtagttaactttgacaaaggttcatatttcctgcctcagtaaattgcaaaccccatgaaaaactctgtattgtctccctagcatttggcaaagtgcctggtacatagtaggcactaaataaggagctgtgcatcttcaatagcaacacatttgctgttgtttctcagttcagcctttcttacaccattctcagtcacatgccaaaattagtagagggagatgggaaaggcctgattgccgatgaaggggtatggcctgagggttctcttaagttctctcggtattttgtgacatatagtatttacctaggagccctggaaaagtttccggatggatctagatactttaaagataaagctattcccatcccaatttccattaaacctcaagtttccataaatgataacaacactgtgtaactgtatcccagttccaaaataaccacacaatattctaagtaaagaggaaagcagggaaatagtctgtagggagcctagaagaaagggagtcaaaggggaagactcggacatcatgtctcttctgtttagaacgttggtggacagatcatagcagatgctttactgcaccttggcaaatgtctctctatgggtctaatgagctgcgtgaggctaagctagccaatggagattgttcacctaattctatctctgattttgtgatcagcaagcaggagtcagattatgttgtagcaaccaacatggacttttctacaggtacgaactaagcaatgtgagctctagagttgagttgacaattatgtttctcactttaaagtttgactttacgttagtctgtagctgtagcatgcattagttgtcccaaggccagtcatctctggatgcactgacaaaatggaatttttcatttgacctgcaaaactggaagaatatagtggctacatcaaggagacaacactgtgaaacagcaagctgacccgagacaacgtgtctggctttccttttctacctctgaaattcctatttcatatctctagctctaacttctcttgagttccagtcatctgggcatctccacctttgtatcccaggcccatctcaaactcatttttttttttggtgtcagggtctcactcggtcacccaggctggagtgcagtggtgcaatcatgcttcactgcagtctccacctcccaggttctagtgatccttccatctcagcttcctgagtagctgagatcatatttttattttttgtagagatggggtttccctgtgttgcccaggttggtctcaaactgagaccagcgatcctcctgagctcaagtgatcctcccacctcggcctcccaaagtgttgggattacaggtgtgagccacctcagctggcctcaaactcattcctaagtgcaaattactaacctcaaacttccaatcctgtattgtacctgctttggatttcttcagaggacttctagcttgcatagcacttacttgttttatacattgtttgtttccctccaccacaatataaggtccatgagacaagagtttgtgtatgttttgttcattgctgtattcccactaccaacaatagtgcctaatatgcagtgggtattcgatggatatttgttgggtgaatggagtcctttcagtcttgttttcaaatatcttttaggttaatgttgtcctttcccttcttattgacaccattacgttagactatgaaatagaatctaccaagtctcatataatctaggtttctgttactttaatcctgtgcatcattgccagatcaatcctacttggaaattatctctcattgtgtcactcccttagttgtagctcaatactgtttaaatataggatcttcagccaggcatttggagctaccacaatatgaccccaatctgtcacttcaattttctttcgtgtgattcctttacagatgccttatagtacaaccaaattgggctgcttgttctttgagtatttcttgaactttactacctctgtacttctcccattcagttactttgctcaggaatgcccatttccagctgtttctgttggtatttgcttttgtgtagctaataatattcatagatgactattttaaaatttatccatttaaaaaattgacattgtggtcagatgaggatttagctcttttatactatcacacttcacctctgtgccacacagcttctgtttttccctccggttcctctgtcctatatgggccacatcaacagcttctgtgcctctggctccttgctgggtttggacagtggcatgttcaagggagggaggtgaggcaggtgacggaggtgagggtgtttattaccccaactctcttccactgtccctcaaacgaaggttattgttccattcaatacggcctccttttcacagacttcttttggattttggtcagctccctccctctttctttggacctaggggacccaaccctgggttattaaatatccctgtgatttccttacatgctgcccacatttttggagatgacatttttataaagaaacgcctctggttaatcctaatctgaatgcaccctctgctttctgttgggatttggctgacagatgtattctctctgcatcctcccaatttagttatattaaaatttttgttacaccaatattattattgttattttttttttgagacagaatctctgtcacccaggctggagtgcagtggggtgatctcagctcactgcagcctctgcctcctgggttcaagagattctcctgcctcagcctcccaagtaggtgggactacaagtgtgcatcaccgcacctggctaatttttgttttttttgtagagatgggatttcaccatgttggccaggctggtcttgaactcctgagcttcagtgatccacccaccccggcctctcaaagtgctgggattacaggcgtgagccaccacacctggccaaaatcaatattatttataataatatgacattataaatatcatagtgttcccccagcaaatttcctttctgatacagccttttgttttttcacaaatcggttattatcttatttgctcatttgcttagtttatgtggagctttttttttttttttttttttttttttttgagatagatctcctctgtcacccaggctggaggacagtggcgtgatctcagctcactgcaacctccgcctctccagttcaagcgattctgcttctcagcctcccgagtagctgggactataggcgcatgccaccatgcctggctaatttttgtttttttgtagagacgggatttcaccatgttggccaggctggtcttgaactcctgagctccagtgatcagcctgccctggcctcctgaagtgttgggattacaggcgtgagccaccatgcccagcctatgtgtaacttttgccgcttcttcctagaaagacagttgaacagattagacattctatttcttctggaaatttccctcctgagtcttaccgtctttttttttttttttttttttttttttcaatcatgcttaggaatagtctaggcttgcattcaatatctctggaatcctaagactttttcttggtttactcctttgatttactgaaaaatatataacagtagtttcctaagaagtgagaggcaaattctttgaggtcttgactctcgaaaaagttcttgataatttggttgggtacagaatactgtgttgaaaatggcttttccctcaggattttaaaagcattgctttattatcttttattatcttgtgtttttgatgagaagtgcaataccattctaattttctaactttttttttttttcaagacagaatcttgctttgtcacccaggctggagtgcagtggcgtgatctcggctcactgcaacctccacctcctaggttcaagcagttctcctgcctcagcctcccaagtagctgggattacaggtgcccaccaccacacttggctaatttttgtatttttaagtagagacggggtttcaccatgttgatcaggctggtctcgaactcctgacctcatgatctgcccacctcagcctcccaaaatgctgggattacaggcgtgagccacctcacccagctttcctaacttttgaatgtgattttaagaagtgtttagaagatgaatctttgtgttagtcgtttgatttttttcactgtgattgacctgtgatacatcctttcactctggatatctgtgtccttaagttcttatcattttttttcttgcaatattatagaatacgttcttagctgcctgctcaacagacattctcttcatattctttgctaacagaatcccgtttttatccgggcaacaatgcgtccagacctacaggatagatacatcatgattgttaaaacaaatcatggtaatcccctttccgtttgccagatgcagcatttactgttccagcttaccttgtaactaagggtggctatgtgatacctttcttctggtcaatacgataaaggaagtattctcgggggaggagaggcttcagggaatggttttattttccaatataagccacaagcataggaagagcttattgtgttaccacttttctcttctttggatttgactgtgagagagcatattgtcaccttaaaattgtaatagccatcttacagtcaagtggggacaagcctaaggcaaaatgccaaaatactgagactgtcagagttgattgagtcagtacatcaaaccaggcacagttcctccagacttcatgttatctgagataatggaacactttcattattttagccagtttttgcgggtattttgtcaggggcaggcaaatgacttctgattggagcatagtcctttgataagtttttctcttcattttccctgtctgtttctggaacttctattagctggagcccctggattcatttctttaccttttcccctcttccttttccccatcccctttctcactgttctaatttcctgggaaatttcctcaattttagccccaaccattctactaaattattgatttaagccatcaggtttttaatctcataaatgtaacattttttaagaattagaggctagtaattattgttttgaaaagttttcttctgctacctgcattgtctttatttcttctgaattccttttctacactgttgtctttagggtaaaggtattcctcaactgttgggtgatactaggctgtctttttatatttgcaaatggttcttaaaagttgattgggagctttatgtatatggatggacttccttatatgtgatgaggcagcaagcaagcttttttgtttttgagaccccaaaatagcagtttctatagatcttttaggattttaaatttcttcaaagaaaatcatcaaaggaatatacagatacatgcaagcattctaggagtagcgtaggtgaaagtgattataggccccacagtttactacctagactttcacttaatccttctgtgatgtactgctaaatattaacaactagttatgtgaaagggggaaaaaaagacctgatttgtagcatttgccaacatctgtgtgtcattattctcaacatggccaatttcagcctaccaacatgatgtcatttaatgtggagttgggaagatacacatagtagcttgccatcatcacatagtatttctaccatacgaacacaataggcgtaaataacctcgaggaaatagtaaaatatagtaaaaataattaggcagttataagctttgaatattgattatgtctgtttttaatacaatttatttaattgtaagcttatataatttaagttttttcaatggcactgtttaacaactggcttgccaaattcctgaaaatttagcaatcagttcttgtgagctggtacaaactagttccagagcatcactgctgtttccagtcctaggcccaaccctcaccatttactgtgtctggccttcctgattctggagcctctattgctgattttctcctgagaatatagttctggtagcctgcaaggtgtggtggtgaaggataaaggataaagagttatggcctaaatgtatgggttgtgactgagtaaaactaggaatctatagcttattctacaggcttttgacaaatccctatattttcagccacctacctaagcacttgccttcgacagtgcctagcaccacagattcctgagccctctttgtctctgccagtaaaagaagcttctctgcagacaccaaagagcagtgcctctgccttcctgggtcaggtgctgctgttctacctgcttcctctcttctaagatgttgacatcacttcttggttattatcttttctcccattctctttgtccttgtggatttatgccttttatatgtcctttctacattttagtggcagcagataaataagtgtattcagttaggtttgtttaactggaagaatagctcaataagtattgcatttaaaatttgttgaattgacttaagattcctggagttgttgtagcagcaactaaactctgtcaattgttgctgctgtcagttagcaggaactctgtcaattagcaggaactcaccaactactgatttatttagtgtattattgtatcctaggctattagatacccactttgatttttcctctattctttccttaaaatgaactttttattttagagtagttttagatttacagaaaagttacaaagactgtacagaatgttctcatatacccttacccaattttccctattataagtatcttagtatgttacatttgtcacaattaatgaaccaatactgatacattactattaattaaggtccatactttattcaggtctccctaatttttacataatgtcctttttctgctccaggatcctcttcaggataccacattacatttaatcagcatatctccttaggcaagtcttggctgtgacagttttcagattttccttgtttttgatgactttgacaattttggagagtacagattaggtatattatagaatgtccctcaacttggatttgtttttctcatcattagactgaagttatgggtttttgggaggaggaccacagaagttaaatgtcattttaaatatatcgtattaagggtctgcaatacttaatgcaattctgatgctaaccacttggagtagcacagactccaagttaaggtcacaatccccagcaagactgctctcacttcagatgctagccatacgtttgggggttcccaggccacccacacttctgcccaactaactacacattcaggggttcccacaagcccttcagctttgataattccctagaatgactcacggaactcagggaagatctatacttacgattataaagcacacaaatcagggacagccaagtgaagaaacacatagcaagaggccagggagagcctcaaacacaaactttcatgtcctctccccatggagtcagaatgtgtcacgctcctggcacatcaatgtgttcacaactggaaagctcttctgagctgtggtgtctggagttttgaattagaatttcattacacaggcatgattgattgaattattagccacatttttgaactcagtgtctgggacccctcccctccatggagttgattgagctgtgttgatatcacctggctcaaaatctccaagtctctaatcacatgattggtctttctggcatgccagctcccatcctgaactatcttattagcataaattctatgatctgaggggctcatgaataaccgtcactcttattacttgggaaattccaagtacttggcatcttcctcccaggaaccaaggatgaatgaaggccggtcaaattctttactatacagcatactatcaacatgacatatcactgatgatggtgaccttgatcaccaggctgaggtagtgtttgtcaggtttctccactgtaaagttattctctcccctcaccttttccgtactctactctttggaaggaagtcactacaggcacttcagatataaaaagttatgcccaacctccttgaggggtaaatatttacattaaattaatcggaatactttgacaagagagatttatatcttcctcctgtttatctatttattaatgatttactttatatcagtgtgggttcatgaatattttatactttggttataatctaatagagctttattttactactcacgttgttctagccttggttgttgggaagtcttgcagaggcatcttgtgttcctttgacttcctcccgccactgtgaattgttttgtttttgtttgtttttagcacttcctttcttgtactacaagatgctctaagctcatcttctgtttcctgccccagtcctagagccagccatttctctagagagcactggttttttgaaattggagaatacgttttatctacattctttttaatcattttcttttctttctgacttttgtttaaactttatttttggaaataatatagctagtcagtgctcattctcattttgggtgagattactgagatacagaaactgtaaatcagggtctgtctttcctcttgcacaggagacaaaaacagcattttaagtaaaaattgcagttgcaaagacccggagtgttttctttttgataacccccataatcccagaagggatggaattgtctaaaatgaaaaagagaagcacagttcagggagttgttggatgagactacggaaacagcaagagaaaacatgattttgacttcatgatttttgtctagaattttattttggagatttaacactggaatttcatctctgggaggcctgggatatctattttcttaccaacattttatgttatgaagaatttaaacatttaacaaagatgaaataattttagcctgaaataattttatggtgaactctgttgatatcacctagattttatcattaactgtttatactccttgttctatcacatatctgtttatccctctgtccatctattaatcttcttatttttgatatattttaattgcagacatcagtatacttcccccaatacttcagcatttgtgtcaatagctagagttcaatatttacttacagtttttaaaatgtaaaatttatatacaatgaaatgtgcaaagtgtccatccatcaacagatgaatatataaagaaaatgtggtatatatacacaataggatattattcagccataaacataaataaaatatagtcatttgcaacaacatgaatagaagtggagccatgttggccaggctggtctcaaactcttgacctcaggtgatccgcctgcctcagcctcccaaagtgctgagattacaggcatgagccactgtgcccagccttaattgccttttatttatgaaaataccacaagtttaaaatccattattttattgactgggcattttcctacttgagactactacgaaaaaagctgttatgaccatttccgattaagtcttgttggctatatgttttcatttctcttcggtaaatgcttagcagtgcaattgctaggtcatagaacaggtgtatatttaagcctcataatgccagaccactttccaaaatggttgcaccacttaaaatttcctctaacaaagtgtatgaaagttccgatttcctcacaaccttgtcagtgtttggttttgtcagttctttaaatatttgagattctggtgattatgtagtgatacatcattgtagttttaatttgtatttccctgttgactaatgatactgagcactttttcatgtgctcatggctattcatgtagcttcacttttatgaagcatcttttcaaaccttttgtctatttttcaattcaatttttttttgtgtgtgagttctggtatttctttatattttagatcagtgctgtccaatagaatttcctacatttgttcaaaatgttcattgtaaaatgtgtctagtgtaattgagaaaaaaactgtatttaattttgatcaatttacgttgatatagctacattgactgatgactaccatatcaaatagtgtagttctagatatgagtcatttttggatacatgttttgtgaatattttctcccagtctgtggcttggctattcattttctttttttaaaaaaattaaaaacaaaatttttaagttttatggaagtatggtagttgtatatatttatggggtacatgtgagattttgatataagcatataatgtgtaatgatcaaatcagggtaactgggataaccatcacctcaaccatttattttttttttttttttggggttaggaagattccaatcccactcttctatttatttttaaatatacaatgaattattattaactgtagtcaccctatgttgctactgaacactagagcttattccttctatctaactgatttttgtacctattaaccagctcatatttatcgcccttccacactgcctttcccagcctctgataaccatcaatgtattctctatcttcatgagatcaagtttttcacatatgcgtgagaacacatgatatttgtctttctatgcctggcttatttcacttaacgtaatatcctccagttctattcatgtcgttgcaagtgacaagatttcattcttttttatggctgaattatatcctattgtgtatatataccacattttctttatccattcatctgttgatggatggacacttaagttgattccatattttggctattgtgaatactgctgcaataaacatgagagtgcagatatctctttgatatgttgactctctttctggttatatacccagcagtggaattgctggatcaaatggtgtttctagttttttattgttttgtttttttttttgagacggagtctccctctgttgcccaggctggagttcagtggcgtgaacttggctcactataacctccgcctcccgggttcaggtgagtctcctgcctcagcctcccaagtagctgggactacaggcacctgccaccacgcccagctaatttttgtatttttagtagagacggggtttcaccattttgcccaggctggtcttgaactcctaaccttgtgatctgcctgcctcggcctcccaaagtgctgggattacaggtgtgagccaccgcacttggccagttttagttttttgaagaagttccatattttccatagtggctgtactaatttatattcccaccaacagtgtagaagggttcccctttctccacatcttcaccagcatctgttattgcctgtctttttgacaaaagccattttaactggggtgagatgatatctcattacggctttgatttgatctgataattagtgatgttgaacatttttaaaaaacctgaatatctgtatatatttatttgtacatcttcttttgagaaatgtctattcagatctttttctcacttaaaaatcagacttttttttttctgcttttgaggtgtttgagcttcttatgtattctggttattaatcccttgtcagatgggtagttttcaaatattttctcccattctgtgagtggtctcttcactttgtttccttagctgtgtagaagctttttagcttgatatgatctcatttgcccacttttgctttgtttgcctatacttttgagttcttactcaagaaatctttgcctgaaccaatgtcctggagcatctcctcaatgttttcttctagtagtttcaagtttcagctcttagatttaggtttttattttgatttgacttttgtgtatggtgagagataggggtctagtttcattctttctcacatggacatctagtttccccagcaccatttattgaagagactgttcttttcctaatgtatgttcttggtccctttattgaaaatgtgttgactgtaaatgcatgaatttatttctgggttctctattctgttccattggtgtatgtgtctgtttttatgccagtaccatgttgttttggttactatagctttgtagtatgatttgaagtcaggtggctttgtaatataatttgatgcctctagctttgttctttttgcttatgattgctttggctattctggttcctttgtggttccatataaattttaggattgttttttctatttctgtgaagaatgttattggtattttgatagggtttgcattgaatctgtagattgctttgggtattatggacattttaacaatattgatttttccaatccatgaacatggagtatctttttcctttatttttttcattagtgttttacagttttcattttagagatctgtattagtccattctcacactgctataaagaaatatctgagactgggtaatttataaagaaaagaggtttaattggctcatggttctgcaggctatataggaagtgtggctggggaggcctcaggaaacttacaatcattgtggaaagtggtcattgtagaatgtgaaggggaagtagacacatcttcacatggccaaagcaggaggaagactgagatgggggagttgccacacacttttaaaaaaccagatttcataagaactctatcagtagaacagcaccaaaggaggaaatctgcctgcatgatccaatcacctcccatcaggccccacctccaacattgggtattacaactcaacgtgagatttgggtggatacacaaatccaaaccatatcaacttcttctctttctccttctccttcttcctctcttcctctcctccttctcctccttctcttcctcctcctgctcctcctcttcctcctcctccttctccttcttctccctcttttttttttttgacggtctcacttccattgcccaggctggcatacaggggtgcaatcttggctcactgtagcctcaacttcctggactcagatgatcttcccacctcaacctcctgagtagctgggactacaggtgcacaccaccatggctggctaattttttgtatttcagtagaggggattttgccatgttgcccaggctggtctcaaactcctgggctcaagtgatccacctgcctcaccctcaaaaattgtgagctgttgtgcccagctgagatctttcacttatttggttaagtttattcctaggtgttctattttatttgtggctattgcaaattggctattcattttcttagtgggatcttttgatgtgcagaagttttaaattttgatcgtgcctaacttgtacattttttaaaatggcttttgtattctgtgacacatctaagaaacttttgatcactcctaagtcaggagtaaatgctctcattttgcactttctcaagaaattttagaatcatctcattaattgctgggattatgattggggttttgttgaatctatagatagcgtgcaagtaacattgactttgatatttttaatttgagactttcaggaatggatatctatgttggtcgatgtattttaatactttggcgaaaggaaaacagggtctgatcagccttctgtgttttaggcaagaagagagcctataatagtctacaaaatacttctattttgtgttgtttactcagaaggactttggacaacaatttctttgactgaaactggggtcagagttgcagactccctggaacatgaaaagtcaataatctagttcccaaaaggcagacaagaaactattcccaagatgaacaaatgatgagaatagaggtaaaggtgaaaatgatggtaagtgtgaaaaatccatttataacacttcaatttgtgttctttaaggaagaaaatataccttgtgctttttctggtctgcagcatctctaaactatttgcctttattttctcaaaagtattttaggaacagtgaagttacacaactttgttctcttcagttcttattttaattcaatatgagcttggaagaagaatctacagattatttcatttaatcccttcatggtgtatgaagtaaacagatttagagttaaatgatttgtctgaggccatgcggctagttagtagcagagttctgacaacatcccaggcttttctatctctctactccactgatatttccagtatgcattgcttttataatagctaaccactcactaactcctgatcccctacaatgtgcctggcgctgtgctacatataggtgatataaattatcattataatatacttttgttcctcaaataccacatagctctatgtaatagaagacatatgaaaatagtaaaaggggccaggtacggtggctcacgcctataatcccagcactttgggaggccaaggcgggcagatcacctgaggtcaggagtttgagaacagcctggacaacatggtgaaaccccgtctctactaaaaatacaaaaattagctaggtgtggtggcaagtgcctgtaatcccagctactcaggaggctgaggcaggacaatcgcttgagccggggaggcagaggttgcagtgagccgatatcatgccactgcactccagcaggggtgacagagcaagactctgaccccaaaaaaaaaaaaaaaaaaaaaaaaagaaaaaagaaaagattgtatgagagagacctgacataggctagcattgctaacttcaatttataaaatgaaagcaatcaaactgcaccttaaattcatgttctattaaataaaatgttaactgttaaggaaggtgaagtttaatgcttgatgaaattatcagagaagtctatagaaaaagaaaaatttgagacagaatttcaaggaatgatggaattaggaagggtagagggattataaactattataatcgggacacaacaaatatgttaataaaaacttgaataccttataaattaaaatgcaatttcaatgcagttcaagacaaggacattacatatgtttatgggcttctgaaataaattacttttaactaaaactaatgaaacacagatttatatgagaagcttagaggtaaattaagtcgtgaagtaggcattcagatttctttctgcagaagtagtgatatttcccccaggcgcttctcttatggtagctggtcctaagggaatactcttttgtcagtagcatgcagtagtcctgtataggtaataagagacctccatctccatattgctttcagcaatttgccctaaaacaaataatctaaactctttgattcctcatttccatatgcagtaataggactaataataactgccctgtcaatctcatggcagttgtgaaaatgaatatatacaatttttatttatcaattatattacacctcaataaaactggagaaaatgagaaatgtacagattatggttcaatgaagattctatgaagatatttttagggacaaaatctgcagtgttgtctgcagcattgacttggttgtctccaaagattataatagcattaataatatttttccttgggtttagataactctatggtgtctgtgcagtatgattaattgaatgcttcatatgtactgaatcttttttcatgaactaggctgatttacaatgatacagttagcagttatttagggtgtcactggaaaattcttgtttatattactttttatttatacattatgtacaaaaaattgccttcttcatgcttgtatccatattatttacataattgaagaatgatgatgaactgctaatgtagacagagaatggagatgaaactaatttcttatataaccactgaagagaagagtggtcatggagagaagagtagaacaagaattataatcatgtttaatttttctttcacttggaaatgacttgagtgggttcaaccattactaagaaaaatataatttgatttgtgaaacaaagagattctaagaatctctttgtttcacaaatgtctctattctctagtatctaatattaaaatattattttatggggttggcaattaatattataaaatgaatgaattattaatagttaataacatttaataactctcaacaaagattcaaactacacaaaggttttaattttgtaacaaaatgtgcaattttttccacaaatggcaaaaaagaattgctcacaagaaactataccttgactgtagacttattaaaatctaggttattgagtattagttatctattgctgcataaaaattgcacaaacttggtggtttaagacaatatgcatttattatcacacggtatctgtgggtcaggaatctgggcacaacttgagtcctttgcttcataatctctcacaagactgcacggaagaatctgcttccaatctcacatggttgctggcagaattcagtttcttgcaggctgttggactgagggcatcagctttctgttggctattggctgtcctttgctacatgggcttttccacagggcatttcacaagatgatagcttgctttctcagagccagttgagggtctcctagcaagacagatataccatgttgtgtaatataatcatagaagtgatatctatcagttttgttgcattttattgattagaagcaagttctaggtcctgctcactctcgggagggacttacacaagggtgagaataccaagaggtgaggaccactgggggccatcttagagtctgtggaaaaagaatggattaatttgacatatggtagagtgaaaagagagggtaaactcagatgcttattagcaattcatatccaattaattctataatccagaagcaattggtgggaatggcttaatagaatttccagttagcgatatagtatcacaaactaataagcacaaggtgctaagtacattattttcttcttctgtgatcctgctctgtctccagtgctgtcagctgtgaaatgagaaagccttccatcagaccctggaaaagatgtaaagagctgtacttcagaaaaatattggagaaaagtacaaatcttaaaaaaatttttttgagtagtgcatttcatcagcagatgctgtcaattttgttatactggtaacagatatctatggaaaatgaaattctcaacagcacattgccagcatgttcccccacaaaaacagccatggttaaataaaatagaaattcttgcacatgattagaaatttgcaaaagagattaaatgtggcattgatataataaagcctttgattaactaacaaaacttcatcaggtatctaaaagagctgtttgaatttctaaccaagtcagaacaccagctattacactccttaaaacaattatgccccaaattaacatcttatatgcaaaaacattttgtctgttttgaagactaacaaagactggaaaagcatgagaaagatgagtagttatcacttcaatagtgtttggattattgagttatggttaattgatggtctttaataggatttacaaagctagtatcatagacggtcagggaaatcctctttccaaacattatatagttaagtcacagaagatgctgtggaaaatagacccaaatagtgcctataagtatagttggtatgaattgaagcactacaagcagtgatagagctgtgtggaagacagaagacaaacatcacacttttaagtttgccgatctaccctggaataaattgatgttacaatccttgatgtttgtatttctgctctgttgctctaagtgagaatataggatgtactttgagagattacagtaagttgtaggagttcctcactcatataaatggattgaacagggccaggtgcggtggctcatgcctgtaaccctggcactttgggaggatgaggtgggaggattgcctgagctcaggagttcaaggccagcctaggaaacatgggaagaccctgtctctatgaatgaatgaataataaacagatttaatgaattctggatctgctgtatttatcgcatatcatgtataatatctttatgtatggttaataaattctaaatagaaaaggttaataaatgaatcaacaagattgggtaccagaacaccaagtagataagatattatccaagccacacgattatagagaacatcctcacattttggcagcagcataaaacagacaaacatctacattatctcatttttcctgaagaaaacagaacttcacatgagctgaaatgaatgcttggtatcatgatgggtctctgtcattgtccttggtatgtcctctaaagtaaaaacaggaaaatcctcttctgaatacctaatgaagtaaggtttcagcaaagtcttgtagaaacttatgttctctagtctctaagaattgaaaggtgggaggggcttggctaaaggaatacttgtttggtactggagaaaatgaaaaagcaaaaacatgggaattctggggttccgtgcctcgcaaatatttgtcttgggtgacaaatttttttccaaattctgattgtgtggctcctgtttcaggatgggctctttgaagctttaaacattaatcagagactatattcaggtataaagcaagcctgtgacctttgtccaaggattcagttcagtcttgtaaatcagaaattcaaatgtcaaatcattcatgatttattcagctttggatatgggcatttagaaacacatgctgtcaaagtatagaggtgtatttttagtcatttgaggcatattctctgaagtctatcccatctacaaagatacatacatttcctttatgtaattttaaattataagaatggggaacgtctttgacaggactagtttatgccagttaagatgctgaaaggccagcaaagtctttgataggggaaaggccatgaatttctagatcacatttcatattgagagagtggctcattgtgggagctattcacttaaacagatttattctatatttcaatgtgcaaattagtattcaatgtagctaagagacagtttcatgcttggagccatgaacagggaggtttgaaaacaaatcacagtgtgaggcaaagtagggtcaattaagggggttgccatttagacaagtcccatagatgggataaggttttctttttggtgagcctttggacaggatgagaaggtcagttgtggacagtaacctcaaactaaaggaactgaaataagtttctgagctttattcagtatattcaacagagacaaactgtccaagataccctattcttccttagtgagttgagcaagggagtggatcacacgttctcagctgacattgacacagcctgaggcctatggaaagggaatgaggtagtcttcttatctgtgagggaatctgaaacttcagtgagtccttagtcacctaagaagggttgtcttttgggaggaacgagggcaaccttacaggtataaatccttcctttttagaaaacaatacaaggtattactctacacataattaggagatattcaaaagaatcttctttattttgatcagtatttatttatttatttataaatttctgtcagggtgggggaaaatcttgttcaatacagattccaccaggattgtagctaagtcacagacagcctatgcagtgtccagatatccacatgctgaggtgaacttcatcttcaaggtatttatctatgcataccagcatccatggagatgctaataactaaccatgcagattgttgccaaatgttccctaattcttgaccttaaggactctttaggatcagcattctcttagccactttgtggctcactcagatctatctatctgcctaaacataacactcaaccattcttattctgtggttctgccactgcactgagctccacctggtaatggggacattgattctgttgttttcacatcccccaagctgatttggggttctgttgtcccccctccccactagagattaatcttgggtgaacaggagagaggtagtctcagagtatgggagtccttcttattcgctgtaacaggcacagattattgtagctcaaataacagaaatcctagccaacagtggcttaaatatctcacataaccagaggtctggaaatgcagaccaggactggtatagcagcttagttatactgccaagaattcatcttcttgccatatttcctctttgtcttcctcagcttttggcttctattattgtggttgtcattattgtgcttttcatgttcacaagatgactgccacatctccatgtcacatccatggtcaaggtgggaaaaaggagttagcaccaactacgttccactcaatcagaaaagcaaaagctttctcagaaacttcccagaaaaatttccctttaccacattgggttagccaattacaaatgactggtacaagaacccatggatatttaagttctcagttttcttcagattctcttcatccctcataatcccaggaaacttgttatagtctgtctaggacagatactaacttggctcattgactacccacttccagtcacattctccattgctttcctctactctacaggttagagagctctaaatgcttaatttctcagtttctcttggttctaaggatggtcatgtgacccggttctagccagtcgggtgtgtgtgtgtgtgtgtgtgtgtgtcttcctttcctgaataaaaaaggcaaaggctcactaggaaattctctttgtcattccctcctcttcctatatggaacatagctttgatgcctgaaggtacaacaaacatctcatgactatgaggggatgaaaatggataccaaggataccaagatgatggaacaaaaagaattgatttggaacatgacggcactatggattcatcgtattggacctctgtgatataattctgaacttttcatataagactaatatacccctacttgtttaatacaactgtagagttatctgctacttgcagccaaatgtaatcctaactaatataggcaataaatcatgtttttatatcactatgtaggtcttccaatctattgtctttgccagagctgtctccattcttctaaaaggtcccaacttccaaaattcaaaaccaagaaaacaacctcttttctctgacatttttattgggtcagacattttgctgtgtcagaaaatgattccatataatttgtccaaatggggaagggctatgcgagatacaaggaattatagggagaaaattattgacacatatttaaaaatatatctcagcatagttacaaatacacagaaacccatccaaattagactaagacagtaaatttattgggtggatgtaagtatatcttatggacctaaggataggaagtccggttgaacctcattatgaactggaaccaggaactgaaaagttatgaaccagtgcagctcttctccctttcctctatggtaacatgatctcttatgatctactttcttcttctctcttgcattggctttatctgcttctgcatgcacatagtagaaaatagtaatttcaactgtattagctcaaagacaaactaagattgactaacacctgttacttttattttccaggctctctggagaattaatctgattggtcaattttttggttgtacatcagtctttagtccaattagtgaccttgggaatggggtcaaatgacttagcaattcttaggaccaaaggagaatacccttttgaaaagaggccatggatatgtatatgtgtgtcagtgttttttggagaagaaacatctctactactctcctaaaattttaatttggggaaaggtaaaccaaagtaatgattcagccattctacaaacattattctcacttgctcctcctcttatgttttctctcagggaattcatctagttgctcatgtcataaacctctacacaaccaatgattaccacaatagctaacaattactaactctgtgacagctgttctacatgcattatcttaagttcaacctcacaacaaccatagaagtaggaattaactattttattgataacaaagtgaaatttagagatgttaagtcaagccttcaagagagagacctcatgtctccttgtctctgatcttgccccgctgatccatttcttttttaacccagtaatcatagtggtatttctaaaacacaaatctgatgttactttcctgcttaaaatccttctatagttcccttaggataaagtccaaatttctttacaagatatatacagcctttcttgatttaggcaacctccatctaaccaaccttcactccatcctcatctcttttagtcactttgtcctaagttgcacagatcatttacagttcttaacaatccagaaaagaaatgtattttctactcctcttgtgttctctcttcttttctctcttctttctttttttatttttatttttgatatcttttttatttttttatttttattttttagtatttattgatcattcttgggtatttctcggagcgggggatttggcagggtcataggacaatagtggagggaaggtcagcagataaacatgtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaataatttttcttagtacagaacaaaatggagtctcctatgtctacttctttctacacagacacagtaacaatctgatctctctttcctttccccacatttcccccttttctattcgacaaaaccgccatcgtcatcatggcccgttctcaatgagctgttgggtacacctcctagacagggtggcggctgggcagaggggcccctcacttcccagacggggtggccgggcagaggtgactccacctcccggacggggtggcggccgggcggggtctgccccccacctccctccgggacggggcggctgaccggatgggggctgccccccacgtccctcccggacggggcagctggccgggcgggggcttttctctcttctttcatctttcttccttctactctcttcttctttcttcttccttcttctttcttctccttttaatttcctcttcctccttcctccttccttctttcttcttcttctgacaaggtgtcactctgctgcccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttaga

SEQ ID NO: 1059 - DNA, 2558 bp, Homo sapiens
cactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaa

SEQ ID NO: 1060 - DNA, 254060 bp, Homo sapiens
ccaataaaatgctgtcttttcattctttggctgaacttgtaattacttacctctgcactcttcatagctttaagaatattccccactgtatcagtaaaggtgttacccagtattctacccaacttcttgtacaaggaacccaaacataccacagcagcactgaaacaacatttaaattagaaattagtcacagctgaaaaaataggaataaaaagatcttaggatatgtaaggataactgttgaaaaatatcccccattctcttgtctttttactttctttgtattatcctttgaaacacaaacatatttaattgtgatgaagtctcatctattttttgtcagttgtgctttttggtgctgtgtctaagaaacactgccaaagccaaggtcacaaagatttacccctatgttttttcctatgagttttacagtaatagctgttacacttacatctatgatcaattttgagttaattttttatacatggtgtaacagaagagtccaaattcattcttttgcatgtggacatacagttatactggcatcatttgttgaaaaagtgactattttaaattttgctttgaaaggataaaatttctaagaatctattctgtggttaaatcctaaggcacgacacttaggtgaatatgattatactttcaataataaggatgtatcaatctgtgattactctactattcagcccaaagattacacaccctcaagtttgttacaaaattctacaaaatatttcaacagaactcagctacatattagataacaaaaagataagcttaaagataaaaataaaaacaagaaataatgttctcatcaagtttgaaatctgaaaactttatgggggaatacattctgttataaggtaaaaatgagaccaacaaaaactttatagaattatgacatggtggccaggtgcaatggctcatgcctgtaatcccaatactttgggaggccaaggtgggtggatcacttgaggttaggagtttgagaccagcctggccaacatggtgaaaccccgtatctactaaaaatacaaaaattagctcgaagtggtgccatgtgcctgtagtcccagctacttgggaggctaagacaggggaatcgctcgaacccaggaggcagaggttgcagtgagtcgagatcacgccactgtactccagcctgggtggacagagattctgtctcaaaaaacaggaaaaaaaagaaatattacatggctcattgcctttttaaagataataggtgataaaatgaactaaatcctatagagaaactaagctgttctttttaggatcttagcaaatacttttctacatgatatttactatcaattttcataaccaagaatgaataaattataaaagcatccaaaaatgtgaagaatttaaaatatctttcttaaacactcaactgctaaaattttaggaagatgttttgaatctcaaatctagacttcaaatacgtctaaagtatttgtagaattgtttctcagcaactaacatgaaaagtgttagtttcttttttaagttagattttgaaaatgagtaaaactgagtttgcattcagtttcaaagtaaatgtcaagtactatgggtacttcataaaaatacaacaggaagcaatattttgttttctgttctgttttaatgtttcacttacagcttagtgggaagataacttggagaatcatctttgctacgaataagatcattacatttatcgattgcttcatgaacggagaatgtgtctccaatactataaagtatggctagattcttagcaagcagtttgcgggtaggaggccctggggagctgttcaacaaagacaggagctgttcaacaagagtcttctgtttctcccttacatcattctagaaagaaagataacacaaagacaattcaaagtcaatataattatctgtaatcccctaatataatttttctttcatatatttaagaactaaaaaggctctagaaaaatacaaacttactttgactggaagttacaaataagttggtagtgtggtcattatgccagactaatcaggtagtttgctgccctgctaataataaaaaagccctccaaaaattccgaaccacattacactgcaatctctgttaacaaatataagggctctatgtattcgaaatctttcttcttttgtttgaaaggcagagcaaatttgtattattattattattgtttttttttttttgagatggagtctcgctctgtcgcccaggctggagtgcagtggcccgatctccggtcactgcaagctccgcctcctgggttcacgccattctcctggctcagcctcccgagtagctgggactacaggcgcccgccaccatgcccggctaattttttgtattttcagtacagacagggtttcacggtgttagccaggatggtctcgatctcctgaccttatgatccacccacctcggcctcccaaagtgctgggattacaggcgttagccaccgcgtattattatttttaatagagacaatgtgaaatggtttggctctgcatccccacccaaatctcatgctgaatggtaattcccatgtttcaggggaggggcctgctaggaggtgattagatcaagggggtggatttcacccatgctgttcttgtgacagtgagtgagttctcacaagatctgatggtttaaaagtgtgtgacacttccccgcaacccttcctgccatgatgtgaagaaggtcctcactttcccttcgccttctcccatgactgtttaagtttcctgaggcctcccactcatgcctgttaagcttgcatatctgtgcattaattaaacctttcttcttcataaattacccagtctcaggtagttctttatagcagtgtgagaacggactaatacacaaggtcatactatgttgcctggggtagagtgcaatggctattcataggagcaattatagtgctacactacagcctcaaattcctgggctcaagcaatcctcctgcttcagcctaccatgtaacttggtctataagcatgcatcaccatgtccaaatttgtattttcaactacagcatctgagttactaatcctacacctccctcatatatagctgcataaagcagtaaactataatctataaccagagctgaccttgtaatggctacctgttttattcaggtctattcctaagtgtagggcaattttctttttgcaagcttacgtatataaatgttaataacattattccattttccttgtctgctatctgaataaagagtacacagtatcattataaagctaatggtattcaggtgctcaatgaggcctaaaattccacaataaaatatttgtcagtgtatagaattttgtcttttgtttttttttccccaaatctagaagttgctttttttccctctcttaaagatcagcaaacttgtcaaatattttgataactagagtcacacagctccctgttgtctcagaacaagaatgtgttttggaatgctactattttaaattcataaataaaatgtcttctgttaaattctaaatgtctccatgagtagtgtttttctaccactttggaactgcatatagtactgtgattatgtgaaaaaatgttcttatttttaggagacgtaggctaaaagtaaagtgccacctcaatggcttagtaaattaatcaaccaaacacggcaaaatgttactaattgctgaatgtaggtgaagggtatgagtgatcagttttcctttttcacactcatgtcataagctttgaagagggaatctgtttatccataggctcttgaattcatacacctcaagtcttcatacctttttaaagtgaaactcccactacattgtttagccactatactgtaccagggctttatgtacacggaggaacatagatgcagaccataacaaaaacgaagtataatagaaagtagttgtagttggtgtttcatatatttttaaagtaataccaaaaacattagctaatttcttcctgcttttctgaatagcgaaaacttcttctaataataaaaattctgatgagggaacaaaaaatgtaatatacttcattaagttttaacaaagtctaacattgtaaagctaaattaggttattctggaaaaaactagaaaagcaaaccaaaggaagtaaacatgggcacttaaacaaaaaaacagatgttgtcattttacccaccctgctggttgccaacaagagcttctccaagtatctcaaccactcaaaaataaactctgccttctgaacttcacctagttgattgtatgcttcttcattcagcagtaagctatgagctaattccattccttgcagcaatcctcccagctgatcacagttcttctcgttaaactttggtcaatatacctaacaataaaaatctgcaatacaggaaaataatgtattttaaaaggggggtaaaaaggaaggcaatcataacggaaatcagaaaagtgaaaacataattaaatgtatacattttttataaatgctctagggtgaatctgggaaaatcccaataatgttctagttaacactgacataaaatccacccttatattctgtactcaagcagacaggcaaaaatagagtagcaatatttgcatttgtatgcaaaaacttgctaaacagaagagacattccactaaaattctgaaaattttaagattaggctgtttattctgtgttgggttttctttgtagtttaagtaacttactaaaatgggtaataggtacatattaacaaatgacaccaaacatccagaccttctactagaattctatagtaaagcttgccatctctctgagcctttgcctagctaggtacatgccctgtcatttacctggagatccaagagggacttaagcccattagcatcagttcccccagcctaataaaggcattgcttatagtttcaggctgggagtttaggagagtccagtcttaactaggcttatctctgaaagtcttgtgagagcaaacttttttaaatgggtattgtccaggaattatagcaatcaagatcatatctgctctgacctagatccaatgcagccttaattttgttgtagcaaacaatcaacagaagacacagggtttgtaaaattattgttttattcaacagcatctcctgggtacaccttagtgctgttacagagcacacgcagcatataagtgtatgtatatacatacatattcacattaacatacaaatttataagatggaattgtgattactagacagaattttttatttttaggacatggatgctttactgcaacttactttttaaatggttaaatcgtgcactcaaccataaaatatggcaaaatgttaacagccgaatacaggtagtgggtatgtgagtgatcatttcactactcttcatttttccacattttaaaaagcacaacaaaaagtagaaaaaattatttaagaaataaaacacaagttggctattaaaaaatactactacttgcaggagtagcagctatcatcaggaacattaaagaacatagaaggtaccagatcatatacaaaagatgggtattcctattcactagtgtacctaaatagaaacatgttaattggaatttcataggaatgtagataaaatgctatggctaatttaactaaaatatttaaaatacatatcttacatttccctaaacaaacctcatacttttacagagaagccagtaactaaagaggtattagaaaattagatgacagacttgggaaaggcttttcattttttcatgtttttctccaacagtttacctgtttgaaattacttagaatatcagctcatcataattataatataactgaaaaaagcctctttaataaaaagacagtagtcacaaactggttccctgttggtcaagactgcctgcaatgcattggggctaacatttaaacataagaagattgcacataaaaatctgggtccagggccaggcacagtggctcacacctgtaatcccagcacttcgggtagctgaggcagaaggatcgcttgagtcttgggtccaggagttcgagaccagcctgggtaacatagacggactttgtctctacaaaaaatttaaaaattagccaggcatggtggcgcgtgcctgtagtccccgctacttgtgagactgaggtaggaggatcacttgagccagagaggtggaggcttcagtaagccatgaccacaccactgcattccagcctggtgaagagtgagaccctgtctcaaaataaaaaaaagaaaaaatctgggtccagtgccatgtgcgatggctcatgcctgtaatcccagtactttgagaggcccaggcagaagaactgctgaggccaggaatttgagagcagcctaggtaacagtgggacactgtctccaccaaaaaaaaaaaaaaaaaaagacgaaagagaaagaaaatattaggtcattttcaaaaatgtcacttttacagaacaaagaatataaacgatgtgaccaggtgtggtggctcacacctgtaatcccagcactttgggaagccaatgcaggcagatcacctgaactcaggcgtttgagaccagcctgggcaacacggcaaaaccccatctctacgaaaaatacaaaaattagccaagcatggtggtgtgcacctgcggtcccagctgattgggaggttgaggcaggagtatcgctcgagccctgaaggcagaggttgcagcgagccaggatcacaccactgcactccagactgggggacagagtgagactctgtcttgaacaacaacaaaaaaggaatataaacaatgctgctaaacattcatttttactgaagcaacaaaaattctagcttgttttaaaaaaccctcctttcctttgttcaattatcaaagtgaactagccaaaatattcacaattaaggatacagttaataaatgctacagaaataatttctggaagaaccctactaaatacagaaaaggcgaaaagcaagtttgcacttagtatctatgattgtttggggggtggaaataaccacagtatcatagagaaaatttcttattaataccagggcaagtcaaaatcctatcttcagaatcaaattaccctttctagaaatcattaagatctgctgaagagacattttttttccttaggcaccagcaatattgtggtgtaaaatgatctatcaagaagcaaaatagctaacacaatgtgatgataaattattcagtaaaaagcttgagatcataagcaggtcataaagtcatctctaatgccctcaatacattccttatgtaaattactcctaaaggaagtagacaattcatgttggtaatctcgcatctaaaactcacaagtctaaaatgcacctgagagctccacattcgcactaccaatgtgataagcaagggcattttgcaaacagatggctgctgctcttatctgaagtcttacctcatcaggaagatgaatacaaattcagtcaatgttatctgctatacgttttaaaataaccacaaccctacatatacctgagaaatgcttatttttctaatttttctcttagtttcccttatgtttctgttgagattataaggtgatttcctacaagtaaacacatatgtcaatatatttaaatatatttttcaaagtatagttagttgccacttgaaaaaaggatttcataaacctgctgctccaaatgtaatgccagctatatttaacagaagcagctaatatttactgcttacttattatagtctaagcagtactctaagtgctttacattatttccttgaataatctgccaaattgtccatgaagcagctattttgattagccctattttacagatgaggacattgaagcacagagaagctaactgactttcccaaggtcacacagaacctgggtgtgcacttaagcaatctgacttcagataagatttgttttaaccacaacatactatgctgccaccctttcatccaatcaagctcctcaaaaatgtgagaagttaggccaggcccagtggctcacgctcataatcctagcactttgggaggccaaggcaggtggatcatctgagatcaggagttcgagaccagcctggccaacatggtgaaaccctgtctctaccaaaaatacaaaaaattagccgggcatggtagcatatccctgtattccccgttactcgggaggctgaggcataagaaccgcttgaacccaggaacccgggaggtagaggttgcagtgagccaagatcacgccattgcattccattgcactctagcctgtgtgacaagagtgaacctctgtctcaaaaaaaaaaaaaaaaaaagcgagaagtagggccgggcacagtggctcacgcctataatcccagcacttcgagaggacaaagcaggagggttgcttgagcccatgagttcaagaccagcctgagcaacataatgagacccccatctctacaaaaaataaaaaaattagctgggcatggtggtgcacacctgcagtcccagctactcaggaggctgaggtaagaagatcacttgagcccaggaggttgaggcaacagcaagccgtgatcaaaaaacaaacccaaagcaagtcattttttaaaaagcttacattttgtacaccatttgtggatatacggaactagagtacactgtttcccaaagacagaacatcaggttccttggtgtaataaacttgggaatcttgcattaagacaaagttagggatttttacctacaagatttctcaggctatttaattaggttaatgtatattatgactctccatgaatgcaatatagtatgaagtattagtcaaaatgctgccagcacctagcaacttctagacctaagcaaactgttccaaggagaaacattaacatgtacctgttatcatcacttattttatttatatatatatatatatatatatatatatatatatatatatatatatatatatgtattttggagatggagtttcactcttgttgtccaggctggagtgcaatggtgcgatctcggctcactgcaacctccacctcccaggttcaaacaattctcctgcctcagcctcccaagtagctgggattacaggcatccaccaccacacctggctaattttgtatttttagtagagacagggtttcaccatgttggtcaggctggtctcgaactcctgaactcaggtaatccatccgccttggcctcccaaagtgctggaattacagaggtgagccaccatgcccggccctattaatgtatttttaaaagctacacaagaatgttaattccattactttacagccaaacattgtatgtgcttaccctaaagccaataactgaactaagttataaaggtatttaaatgcttttagactaggtatttctctgggcactatttgcttctctcaaaactgtctgtactttgtacatgacagatactcctagttactcagtcatcattttcataccagaggtcttttatgttgagaaaagtaggcactgcaaactagacctaaggtaccaaggtaacatccaaattatgcttttcaaattgggataactccagcattgtgccaacagattatgaagcatattactatgctagaggtcaaatttagactaaagggtcaaattttacttaaagttttccctaagcattaatttttaacattattttatattaaaatacagatttatgcataatagaaggcaaaattaataaaacacttcaagataaaacatgagacttcaaagaaatcctgagaatgataatgcctttctagatgtcctttaacaaaaatcactcccttttgctgataagaatactattttaatggaaaaattgaagaaccactaagctatgagtaagttgaactatatgaaactgccatttttataggtgaaaaaaaaggctggcttgacaatttatgtgattcaacttaagtaccagtcttcaaatgtcagacatagtgtatgtactaatgtctgtactttgcatagtattctttcctttcgattggctctgtattaagcctagtgactttattagcctagagtaacacatatgtatattattgactactaatagaaaaaggaaccagcagggcaccaatattctagggccagagttttcttttctttccttttttataaagatggagtcttctttgggaggccgaggcgggcggatcacgaggtcaggagatcgagaccatcccggctaaaacggtgaaaccccgtctctactaaaaatacaaaaaattagccgggaggctgaggcaggagaatggcgtgaacccgggaggcggagcttgcagtgagccgagatcccgccactgcactccagcctgggcgacagagcgagactccgtctcaaaaaaaaaaaaagatggagtcttaccctgttgcccaggctggagtgcaatggcacaatcttggctcactgcaacctccgcctcccgggttcaagtgattttcctgtctcagcctccagagcagctgggactacaggcacatgccaccaggcctggctaacttctgtatttttagtagagacagggtttcaccatattggtcaggctggtcttgaactcctgacctcaggtgatccaaccgcctcggcatcccaaagtgctgggattacaggcgtgagccaccatgcccggcctcagagttttcttttctaaagtaacttactccaaaaccacatctaagagcagttaacaaccgtattatcaggccaggcgcagtggctcatgcctgtaatcccagcactttgggaagccaaggctggcagatcacttgagccgaggagttcatgaccaacctgggcaacatggcaaaaccctgtctccacaaaacatacaaaagttagctgggtgtggtggtgcacacctgtagtcccagctgttcgtgaggctgaggtgggaggatcccttgagatagggagatggaggctgcagtgggccaagatcgcgccactgcactccagcctcagcaagaccctgtctcaaaacaaacaaaaccaaccatattatcaacaagggttggttttaattcatttggaaatgagttaacttcaattttatttaggcatgacagtgtaagcaccttcaacaatgtcaacaaatatacaggctgctgattattctggtcctgatagaaactgctaatataattttctctctctagagtttacaggtctattttggtatggacggaaacatatgttgaaatttattgggagaaaaaagtattctaatcttcttggtcattttagttccttaaaatgattatatcatttcaagggcggaaaagggaaaaatcacaaataatcaaagaggacattggacatgagataagataggtttattggattggtttgttagtgtcttccttctggagcatgaaaataattcacaaaacaaaaaagttactaaacagtaaatgaaactaattccagaatgtatcaagtacctgaagtgttgggatacgtctcagacttaaatttcaattatttttctttgacttttacttctctaaaagacaccgtaacagcttcaactcaccctatagtcttagttcctcagttctgaacaaaaagcatgaagtaaacaaacaaaaaaaaccccaactgtcaagaactcccacaattcaagaaacacagataaatcctaaaatctaaacctctcccaaaaatacagtaattagctttcatctagaaggaagctagattattctaccctgacctcagattttcatttgtgatttaggctttgcaaaattatacgttacaaaaacaggaactcaccagttacacagagcattaggccacacttgagatgttgcttaaagaaggctgcccctggtataaagaaaattaagtccttttgttacagtactttatacatctctaggcagaatcctaaagctggtttgctgacacttaactggtacactttattagttttagggtaaaatggataagaagcaagtcatttataatgttagagttctttaacacagttaaaacttgataatttaaaaatcttgtctgtatcaattccatctttgaatctgaaatatcttgcttccttctttctacaataaaatactttaaaattaggctaaaaaaaatcacttgcctcagaaaacagcagaaaaatctctgaaaatgaaattcaaacttaggatattattctgtatgaccttaatattagtctttctaattctctataacaaccctacaaataaattggctatcattagttaaaaatttgaaatgttaacaatataataatgatttaagctcaataggaaataatttgattgagctgagtggttcaaacctatgcatattaaatctaaatatgaaaaatgcaaaaacttttatagccaatgctgaaattttagaaaagctgatagtttaatataaacagtggcagtacaaatggttcaactcttttagaaaaaaatattatttatcagaggttacaaaaatatcaaaaccatttgacaaaaacatccagtttttgaaaattcataagaaaaaggaaaatataagtataaaagtattaattacagcactgtaattaactgtaattccagtgaaaattcaaaagaacttacaagtccaacacaagagaaatggttaaatttgacatattcaaagaatactaggctgtcatataaaaccatgaaaactacaaatgcacaggagtgcaaaaggcttaatgggaggaaaaaaaagtaaagaaaactacgagtgcagaagttttacatgttaagagaaaccttcagataaagcagtgtttaccaagagtactttgtggaatgctgccagaagaatgaaaacatgtattctgtgggaagagggggaaatccaagttgaaatggttttgggaaatgcctcgttgtcagttttcttcaccagtttctccatacatgtaacatggtaatgtgcactatgtactgccaagagggtgtgcagatagagcatttgatgtttctaaacatgttttaaccataggcttctcctccactccctttttctttttttcccagccaggaatctcatagaattggtgttctatagaatacaatctttgaaatactaatcattaaagactagcatacgtcaaaaaaatttaaaattttttttgttcatattataaaatgatttctttctttttttttaagacagtctcgttctcttgcccaggctagagtgcagtggtgtaatcttggctcattgcaagcactgcctcccaggttcaagctattctcgtatctcagcctcccaaatagctgggattataggcatgtgccaccatgcccggctaatttttgtatttttagtagagacagggtttcaccatgttgaccaggctggtctcgaactcctggcctcaagtgatctgcccgtcttggcctcccaaagtgctgggattacaggcgttgagtcactgcatgcagcctgaaatgatttattgctagtagaaggatatataatttccactatcaatgactatcaatgtcatacttctacttaaaagagggcatttctgattagtattttggatcaaattatctatataaacagaatcttctcataaagatgtaaataaagaaaaaagacgacagccaggtgcggtggcctgtaatcccagcactttgggaggtcgaggcgggtggatcacgaggtcaagattgagctcatcctggccaacatggtgaaaccccatctctactaaaaatacaaaaattagctgggcgtggtggcacgtgcctctagtcccagctactcgggagcctggtgacagagcaagactccatctcaaaaaaaaaaaaaaagaagacaaatatatgatgttttaactttgtatatttaagatttatcaattcacataaaaatctgtgttagtctgtggccaggtgcagtggctcacgcctgttaattccagcactttgggaggctgaagcaggcggatcacctgaggtcaggagttccatggagaaactctgtctctactgaaaatataaaattagctgggcgtggtggcaggcgcctgtaatcccagctacttgggaggcttgaggcaggagaatcgcttgaacctgggaggtgaaagttgtggtgagccaagatgaggccattgcactccagcctgggcaacaagagccaaactccatctcaaaaaaaatttgtgttattctataattgtaagtaactttcacatatacatcctttacaaactaaaaatgcttgttgtactatatattttaaaatttgatttacggaattctgaatacgaattcccacagtcaaatgaatccatgttttctaactcgtaccacaaaaacttaacttatgacgaaccccaggcacggcactaatacttctaattgtaatatataatgaaaacacattcagtgtaccaagatgccaagaatatttcctgcaaacttggtaggaacgggaagaatgttgccgctcaccactgcataatacaaagcaatatgaacagcaaatacacactgctctaagaactgatggggagcacatcttattaggatggagaagtcagggtggagtaggagagaaacaggagttaccaagacaaagaatttaacaccgggacaagaaatttataagaagtggggtgaaaaagggttacaggttggggactgaatttactctgccttctttttttttttttttttccaaaatactgcatgttattgtaaggaatgagaaaaatggtagaagctggattccatgatggcgagattgccagtgggagccctaattggactataactgtgtgtagcaattctccttccagattacaaaagagaacaccccggaagcgtaaaagaaagtgttctggggggtgggaggggataagactgagcagtaggaaccaactctaagatgtcagtgacagaaaaatgattattttttgaggatctacgtactaaaaccttttaattcactatctcatttaatcctcgtaatactgaaacttaagatattattattctaattttacatagaaagataatgagctaagaaatttgtccgaggctgaaatgctacttaagtggaagaagaaggtaatgtccatgtctgtctgtctaaacgtccacattctttcaactacttcatatagtctctacagtaatcactgctattactaatacagttattgccatagctggtgaagcatccagtccttctaactttgttgttctttctcatcacttcacttttatgtctccagtactttgaggctttttgttagtgttatgtcttccagagacatcagctttcagagagccctttccatctagacggcaaatcaataagtactaaaagtattagtttagtctttggctattcttgactatttttattatgcttcattccacacaccaattctcccatctctccatggaagggggatttcattctggacctttaggaatgccagaggcagattttaagttaagaagttttacttttcttgtatctcccaccacactcttctgaaagtcactagctagcaatcacactacttggtacctaactgagattccagtaacaggaagtaaaaaaacaaagtctatagagcaattgtttcagaactcgtggattttactgacataaatccatcaaagcctattcattcttagtttagacatgactaataatccagttatttggattctagatagagaaacacattaaaagtaaaagagcaaacccactaagagcaggaagctaacagtgatgaaagagacaaataatattgaatatagatatttttaaaagcagagcaatatagggctacttaatacaggtgcaaagtgtacaagatgccattattcctccagcacatcagggtttacaggagaggccagaaattcttgcccccttttaaaaatgagtcaatccttgcatctgttgcttgtgcaatctgctatctaggacttccaagtttaggcattagactctacctgctttggaatcttccttttccctctcctctaattgttcatgtctcttacatcccagttagaattcacagattcacccttaatccacactatggtctaatgtcctggctcttcctcatggttcctacatttatttatttatttgtttgtttgtttgtttgtgacagagtctcactctgtcgccccagctggagagcagtggcaccatctcagctcattgcaacctctgcctcccaggttccagtgattttcctgcctcagtctcctgagtagctgggattaaggcgcgcaccaccatgcccagctaatttttgtatctttagtagagacagggtttcaccatgttggtcaggctggttttgaattcctgacctggtgatccgcctgccttggcctcccaaagtgctgggattataggcgtgagccaccacgcccggctggttcctacttttaattcacaacctacctcataaaatttagctacctaacctaaaatttagctaaatttctaacctcttggagcctcacctgagggctttccttggcaggcactgcttctcactccctgccagatgtccagctaggctctttgcaactacagctccctggaataactccgtattattctgccttctgactgccactttcatgtcctactcatggaatacagtaaacataccatctattccatcaaatccccacaattgtctggagcagcactctgtaaatcaaactaactgatatttctgcagcaaaagataggcagattcatattcacatacgatgggataatgactgcaaatacctttgcatcagttcaggtcatgttttgctaccaaatgaattaagaaaaaaacttttcagagccttttagactccagaattagaactaagggattttgtacgtgtatatctgctttgctttttttctgatttcctcccaaaatagttttttaagagttttggtgattcaatgggtaacttcagttttctggtaattttatttacataaaaaaggtgttattacttgtttcgagtaaggtattattttgtgtacagacacacaaatatgcatatattcaacatgtagaaacctccaaatgcaacagaaaagtatataaatgctattgtatatttacccattaagaagcattacttgggcaatacaggacaactaagttactgaaaaaatacattacacacataaaacaacaatttagtaaaattagcaccatactatgggtttttttttttccttttctttttttttgagacaggatctcaatctgtcgcccaggctggagtgcagtggcaggatctcagctcgctgcaacctctacctcatgggttcaaacgattctcccacctcagcctcctgaatagctgggactccaggcgtgtaccaccatgcctggctaatttttgtttttgttttttgagatggagtctcgctctgtcgcctaggctgcagtgcagtggtacgatctcggctcactgcaacctccacctctcgagtttaagcaattatctgcctcagcctcctgagtagctgggattacaggcaccggccaccacgcccggctaattttttttttgtatttttagtagagacggggtttcaccctgttggccaggctgatctcaaacccctgacctcaagtgatctgcccgccttggcctcccaaagtgccaggattgcaggcatgagccaccgcatctggtcgatggttttaagattggcaaaagtatatgtacagctttaaatatttaaaattatcaccttcttcaagatttccttcatttttgtcacataaccagctccaatttcttaggcaaataattaatatagtgctttaatatggccatattatgcttcttttctagaaataaatattttgtgttgttaccattaaaaaaaaaagaaaaaaaagcccaagcatgattcaggatatatactcctgtttcaatctgttaggtatctgtttaaagagtgctaactttccatttggttctcactgtaaatatgtctgatttcttgttcagttacacttccaataatattctgtctgaccttatgaccaactaggaatcactagattcctgtttaaaaaactcttttgaggccagatgtggtggctcccacctgtaattccagcactctgggaggccgagatgaggggattccttgagcccaggagttcgagaacagcctgggcgacatagcaaaaccgcctctctacaaaaaatacaaaatattagctgggcatggtggcatgtgcctgttgtccctgctactcagaggctgaggtagaaggatcgcttgagtacactccaatgactctgtctcaaaaaataaaataaaataaaaataaacaaataaataaaacaaaaaaaaccctgctttgagtaaaggtaccttactgctgcttatgataaaccctatgaatggcatagtaaaaagagagaagtttactaaacgaaaaaaatttcccataccagatctaaattaaaacttaacacagttgctagagaaaatataaaaactcttcctcttccctagacttacaaaaggctagagttggccggggcggtggctcaagcctgtaatctcagcactttgggaggccgaggtacgcggatcacgaggtcagaagatgggaggccatcctggctaacacggtgaaaccctatctctactaaaaaacaaaaacaaaagcaaaaaacaaaacaaaaaaaattagccgggcgtggtggctagcacctgtaatcccagctactcgggaggctgaggcaggagaatggcgtgaacccgggaggcggagcttgcagcagcccagatcgcgccactgcactctagcctgggtgacagaacaagactctgtctcaaaaaaagaaaaaaaaattagatgggcgtggtggcacgcgcctataatcccagctactccggaggctgaggcaggagaatcgcttgaacccaggaggcgcaggttgcagtgagcctagatggcgctactgcactccagcctgggggacagagcgagactccatctcaaaaaaaaaaaaaaaggagagagttgccaaaattataaaactttacactaggtaaatgtagcagaaaaaccatgcccttcctctatcattacacactgcagatccagaagcatttatgagtcctacaattacctgacattataatgaaaaaccaagattaataagtaaaagtgaggctgggcgcagtggctcatgactgtaatatcccagcactttgggaggccgaggcgggcggatcacctgagatcaggagttggagaccagcttggccaacatggtgaaatcccgtctctactaaaaatacaaaaattagcctggcgtggtggtgcatgcctgtactcccagctactcgggaggctaaggcaggagaatcacttgcaccggggaggtagagcttgcaagtgagccaagatcgcgccactgcactccagcctgggctacagagccagaccctgtctcgataaaaacaaaaacaaacaaacaaacagaagaattaaaactgaatttaatctatttcctcctacaaaagatttagtgattaagcacttaagagctctagttcaggggtccactaatttttttctgtaaaggaccagacaatactctaggctttgggagccatacggtctctatcacaactactcaaaaacaaaacatgcacagccataacgaaggagcattgttgtgttcaataaaacttttataaaactgccagcagagcagatttgacccacaggctgtagattgctgagcactattttaattcaaaaatttaacactagaactagacaagggatctaattaagtgacacaggcaagtctttactaagttttttggccccagttaattgatttctcaaatgagatttaataacagtttctcaatgtctcctgaaaaagcagaagtgttatttatatgaggactgtggtctcattaaaggattgttcaaactcttcaattatactatgggataattaatgaaccacacaagactcaatagagctttttaaaaaaatgcagatgtcattaaacgcttaattcagaataattttagaatttaaaaaattcagaatttaacccttatgttattcatagttaagaaagactattataaactacctcaacctttttgaaacaaagcaagaagaaaggtaagtgtattggttaaagacaagtaaaaaaataatttttttctgtagataatatattcattagtttaatgtagttaattttaattaataatttaagaattaaaaaggtactttggagtcatgtattttctgtgactaaagtcagatacaataatgaataatactaaaaaagtgacctaatctaacatccataaatagtggagggaacttaagctagaattcaggtctcctgactttcaggtgaggagtcttttcttattctcctattctatagtcatctaggtaaaacaactgcattccaaggcacaacaaatccatactacagtattctccaactgtcactattcttatattataaatcctgcctgcttatcagtgaagaaaaaaaaaaagtcaatggcattaaaatgtaacacaaatctcggcttcgatactttatctaaaattactttctcaaagacatactttctaaaatgtttggaaaattaaacaaaattctcctctccccatccaactaatgctcaattctaaccacacttctgctttccctacagcttaagtaatttcactgggagtattttctctggaagttcttaagtgtacttgtgggcccctttttttcctccttaaacttctaatatctttcaggctgtaaattccttaagggcgcctagccccaaaaaagtgctgcatatttgttcaataaatgaatgcacataaaaacaatggataactatgacctttaatgtaggagctcaagccattttattattatctgacttgacagtcaagaaaattatcccaacttgccagaggtatccattactgtgataaataaacactataaaacgctttataaagtttctaaagactttataatcacttgaaataacgccgcgttggccgagagtagggtgaaagaaaatgtttcctcacactaagcaaatgccaccaaaggaaaagctttctttcctggagagaactgcaacagttagaaagcaaatatccacactctccactgctcccttctgggaactctctttgagggttcctgcagaaaacgaacgggcctctgaggaagctcgcccgaaggccgggccggggcccggctcctggctgaccactggcgcagcggacgccgcagggcgggtcccgggagcggcgagttggcgaggcgggctccgacttgctgaccttccccacacgcccggcaaccccggctcccgctggcgggcagagtccacgcctacctgttgtgcacaggtgaagccagactttcccgtagtccaggaggaagaacggaccacgctgtttatcagccgaccctgtgccccagtcagccccttctcggcggactccagcccttagggtcaagacacctagcccctcgaccggttctcccaccggcttctttcgcgatcacattgctgccgcgaccaccctcgggatccccgagcgctcaactcatacagcggccctggtgcgttctccttcccagccaacaggcagcccagacacagccccctcgcgcccggaggtgtccccgctccctggatccccgactgcctgcctttgggggtcctcctcagctgagcgtgcgtcccggtccagcaacgttaccggctgctctgctaaccctagcagagtctggaattgccggcggcggcgacagcgaggcattgaggtgggcggggcgcgcgtggggcgtggccggaaagctctcagcggcgagcaccgcgggagctagcgattgggagcgcgccctgcgccgggccgctggtccaaggccccgccagctggccgccgagccatcgagcgcccactctggcaggcgtgactgcttcaccgtcgaaagagcgatggagactgcggcccaagttaggattaggacagcggtttttcagtccggagattccggccacaactatttttgtctgtttttatcgtaagccagagtctttgggtgcagctctgggacacctaaagggcctggagaaattcaggcggggccagtgctgtgggggtagatgttagacgtggaagggaccctagagagccttgactgtgaggactgaggtaaagtgacttgctcaaggtcacatactaagtcaatggcagaactgagactaatagcctcttaccttgagtcatgtgcgttttcccactacactcagcgttttaaatgtcatttttcaagtttcattttgaatctatctccagcttacaaaaaggttgcaagtatagtacaaagaactttttttccctgaattgagatttaaattgctgacaccatgccacattgtccctaagcaccttctacataatcacaatataaccatcaaaatcaaaacatttacataactcggcgttttaccaattgtcccaataatattgtttatggtaaaagattccgttcagaatcaggcattgtatttacttatcatgtatctttcctactcttcaaactggaactctcagtcttgccttgcctttcatattcttgacgctgttaaagattcctggccagttatttttgtagaatggccttcattttgggtctgtctgatatttactcatgattacatttagctaggtatgacaggactctagaagtgttgctgctttcttctcatggcaccctatcaggtggcacgattttaacttctctcattacagatgtttactttaataaggtgatgtctgttaggcttgtccagtgtggttacttttttcccccctttgtaaattaataagtattttgtgagggagactctgaaactctcctttcaagatatttgtaaatatcttgtttctcatcaaatcttcagttaatgtatttatattaattagtatggatccagaggtttctattttgttaaatgacttataatccgtttctttctctcttttctctctctctttttttttttttttttcttgagacagggcctcctttgttgcccaggccggagtgcagtggctattcacaggtcgataatgcaatcatggtgcacactacagccttgaacttctgggctcatgtgatccttctgcctcagcctcccaggtaagtagctgagactgcaggcatgcacaccaccacaccagccaatattctgtctctatcattatttattttgatgctcaattatcccaagtttggtgggtaggggccccattcattctatcttctgtgatatgtgtgtgtgtgtgtgtgtgtgtgtgtgtgtgtgtgttcaatttttttttaagacaagaagacaaggtctcatattcattctagcttctgtgttgtgtgtgtgtgtgtgtgtgtgtaatttttttttttttgagacaagaagacaaggtctcactctgtcacccaggctggagtgcagtagtctgatcacagctcactgcaggctcaacctcctaggctcaggtgattctcccacctcagccactcaagtagcagggacaatgggtgtgccactgtgcctggctaattttgtttgtttgtttttgtttttgtagagacagggtttcaccattttgcccaggctggtctcgaactcctgggcccaagcgatccacccgcctcagcctcccaaagtgctgggattacaggtgtgacccactgtacccagccttaaattctctctctcttttttttttttttttttgagacggagtctcgctctgtcacccaggctggagtgcagtggtgtgatcttggctcactgcagcctccgcctcccgggttcaagcaattcactggcctcagctcctgagtagctgggattacaggcgtgtgccaccatacctggcaaatttttgtatttttagtagagacggggtttcactgtgttgctcaggctggtctcaaactcctgacctcatgatcagcccgcctcggcctcccaaagtgctgagattacaggcatgagccaccgcgcctggccccagccttagattctgtaaacattttattgtaaaatattttttaatacagaataattaaaagagctttaaataccatatacacataatccagattcaacattaacaggttaccattctgaggccttttgacacatccccatcattctttcagcactcccctagttactagggcaattagatgtttcatactcatcctgctccagccttggatgtaatcatttattcaggagccctgattccttatagcggagaatggtatttagcactaggtatgctcactgctattgagatatccatagcccaggctgtctgagtggatgcagttagggaatatttatacattcatacacatatacagcacatctttatatgtatccttacacacacatttacagttatatttctttgtctaacaatatatattgaaaaatcatgtgttcacagtaaaacctccaatccagcatcatacagttcattctagtttttgcccttccacatttataactactttctcctacagagagaagcctggctcccattatccttgagatatttacttatttgaacaaccctgctatgtgtgagcaatcatccatagttgccatctattcctttggaggatactgcccttaccccactaaggttctgaaagccccaaattagccatctcaagcccctctctcatctttctttccttaccatcactcccacaccctgtgatcatgcctagcccataaaccctgccgacaatgctcagacccaaacatcccttgccaagcatcccccttacctcactttatatagattagacatacactatatataatcatatatattagttatatattctttacagcaccctatatacacatacatacattcaatatatagattagttatatatctcatatattcattatatattaatttttataaaaccctatatatacacacactatatatgttatatatcatatatatttgttatatatattacttacagtacctaaaacatgaatcacatatatagtgtgtatatcatgtatatatgtatatatatagtgtgtatatatacagtgtgtatatgtatatgtaaagaataatatgcaagacatatattgtgtacatgtatacaggatattgtaaagtaccctaaaaaaggaacaaaactattataggatcctgaaggagagagcaattactatgaagtacagctgggaggctcatgaagggtttaaagagatgacatttaaaatgggctttgaaggacacataaggatggatgagtagaatatatgctattagatattgaaaaaactctggaccttttagcaggctcaaagcagagaaagaaattcattttgcctgagtacacggtatgagaataacaacattagaatttcagaattggaagggatattatgtatcgagtccaactaatagttttacaacagattcaaagatggctccagactttaagctaagtgactaagagaatgaaattagaaggtggagtttggaggggaagataatgagtttaattttaaacatttcacatttgaggtgacagtaaggcatccaaggggaaatgagggactacagcttagaagaggggtcagagctagagaagaggagtcagagctagagatgtagaatccgaatttttccacctggtgctaacaactgacagcactctgaaacaaacaccaatgttatcatcttaaccaaatggaaatgtgtcccactgttcaactaccattatagtttgattatactttgtttaattttaaatggagattttgagtcacaataaagaagctgtattataggtagcagaaagaacatagctttggaattggtgacttgcgttcaaattctaattacaccacttagtaggcatgacctagggaaaatcacttcatatctcagaagctcaatttcctcacttgtaaagtgagaatactatctccttccctgaggtgttctaaggatttgagatataatatataactagcatgttatatattacttacagaaggtgctcatcagatatttgatgaaggaatggagaatttgatatacttcctacttattttatactcaccactataaagcattatactgcattttctaggctttgtataacagaaaaattttcccaccaataaatgaaacatttttagaagtataacagttggtatttaatggtatatgtaaaaatattgaagtaagccagtggttacccatttaacttgctatgtgatatcctgctataatttattgttcaaatataactaattcaatgatttttggttccaactagcatacatttgggaaactgaaaatgatagattacctttaagattacttctatttctgaaattgtaaaattcaatgatggtagaacaatattactccaacaatggaattctagtgtacccatggaactctagggtcctcctcttgatggtacccctcaagaggttaataggagttcctttaaaaaggcattcttggccaggcgcagtggctcacgcctgtaatgccagcactttgggaggctgaggtgggcggatcacgaggtcaggagatggagatcatcctggctaacacggtgaaaccccgcctgtactaaaaatacaaaaaaaattagctgggtgtggtggtgggaggctgaggcaggagaatggtgtgaacccaggaggcggagcttgtagtgagcagagatcatgccactgcactccagcctgggcgacagagcgagattccatatcaaaaaaaaaaaaaaaaacattcttaaataagtctgagaagcactacatattaatatattatagccatttcttagagagtcgttatgtatattagtgggctgcatttgatgcaatgtttcacaaacttatttggaatataatatcctttttttttaaaaaaggaatgcatattaataagttttagaatgaatgtttctgggatcagactttggaaaatgcagctttggaagtttgttattagtgatctactccagtcatgccaggttgctcaatgttgatggaaccactgaggagactaggcttcacatgtggcaaactcatgtcacaaaattcatgggtaggcacagcttccactctgttgatttcaatgtgatctgaagcctgagatgacaccaataccctactctaacaaaagatctgctggccctttgtgatacagctttccactttgtagtctatgaagcattatttgtcaatatactgctgagcttgctgtaatctgtgacagcttttagcactaaatttctaatgagaacttttggcaatggataggatttcccccagtagcaaactaccactataaatattcagttcaagaagtgcttaaaaacagagtagcagatcttgacctatcatggcaagtaagagcaagccatttaacctagaaagaaactgttaaactcagagctggtgcttctaagcaggaatactgaacaaaggtagatctgcaactatgtatttggtaacgcttgacactagaaatgactgcaattgtgttcatacctaacaaggactcctaaggcccctcccaaatcctcattctctgatcagatgaagaaatacagtgctttatatgtgtgtataagctttatggttttgttccaaacttgctgtaatattttataagaaagccacttaacctctttgaacggtgcttttctcctatggaaaatgaacatgttatattagggggtctcttaggggttatcctctgattttatctttttgttgttgttgtttgtcttatttatcctctgattttatgaaaatcattcttctggttttcataaaaaagggaaagagacttcaggaagtcagtgttaagatgctgtaacctggagtgggagagaagaccctggagattgcctctggctactgctttaatatagttttcaccttgaaaggcaggaaggatgtgaccctgaaggggtgagcaccaggacaggaaggttccagtggagagggggaggatcaggcagcaacacacctgcagtggccagggacagcaggttctgcataatggaatctgtagcagactttaagaagtgggaaggtggtgtttgtggggaatcaataaaagtcgggctaaacggaattaaaacaaagtccttggtctgctcatccatgtttgcctgccagaaagtccctgatgggaaccacaggaaacactatcataagccaaattaatcacaaagttaatctatcaaggtgaagaagcaaaagttaatgaccttccagctgagttctaaaaatgagccaaaactcagagaatgggatagctcaagccagagctaggactgaggaggagggccatgttaattaactattatacaaaccctcaacttctgccacaagctctttaggaaagtcaactgttttacatgctgacaggtaactgaagaaagtaagttagtgcttttattcatggatgcttcatcctttaggagtagcatataaggacccccacagaaatcctattcaccagttggatatatatttgatatgaaaactaatgaaggatgatcatccacttcaaagttaaatgttagaatagtaatcacacaagacaacattaagacccaaataatttgtaataagattcataatttaagattatttgtcggccgggcgtggtggctcatgcctgtaatcccaacactttgggaggccgaggtgggtggatcacgagctcaggagttcaagaccagcctggccaacatggtgaaaccccgtctctactaaaaatacaaaaattagcagggcatggtggtgtgcacttatagtcccagctactcgggaggctgaggcaggagaattgcttgaagctgggaggcagaggttgcagtgagccgagatcacgccactgcactccagcctgggtgacagaacgagactcggtctcaaaaaaaaaaaaaaaaaaagattatttgtctaattcaagaaattgaacttatccagcaagctggctctacatagttgataaataatattcttgtggaattattttatatataaggaaaaactatatacctattataaaaatacctatagaaattatcagttactatgtttatgtatatagatctattattatcttctttgggacatatgattcttgaagaaaattctaataaaaattagtcatatatcaaacttcttgtttagctacaaacttaaaggcaaaaaccctatctagatgcaaacattcaactgaccagtatgaacaatagctagaaattgaattacccatgtaatatggttaaggtaatcagtggagccagagtcgtagatctggaagaaaaagaaaaatgttaataatatggaatagaattatatactcttgaattcaatttgccagcctacaagcattcacagaccagagcacaaatccacttataaaccatacttgcttatcttaataatattttattgacttacacattttctcctgttgtttgcttcctttcccttatattgtctgagaccaaaatcaagaaagacattttcttaaatatatgataaaatattaagtttttaaaaagcaaaatattaaattcctttattctaattgaactatattaaaatatgtgtatggttatgaacaacaattataagagattaaataaaaaggaaataattgtatttgaatcatgagattaggagctcttttatcttttcaatatttgtagttgttttactgccttttttacaaaaagaaaaagggcaaagcattttttaaagttttctctttgtaatatgctgatgcaatttttcctactttggaaaggtacttgacacagagtaagtgctcaatgtaaacttgttgagtaagtatacaaaatggcaactaaaattgctggcagatttcctttagggagaagctaaatgatggtactcgccatgctgaggtaaggataaaataagtcaggatttactcatccacctagccaggggcctccaattgcctatccttgcttccttgagctggaattagagatttattaggagggtatccatataatttagtgtccatggggacagttcttagagcaagaagagagctattaaacacactgcttggttcttagatataacacctaaaacacaagcaactaaagaaaaaagttgataaatcggacttcatcaaaattcaaaacctttgtaattcaaaggacattatcaaaaaaaattaaaagataactcataaaacagaacaaaatattttcaaatcatttattagatgagtctagtacccagaatatagggcagaactttttggttttttttttgtttgtttttgagacagagtgttgctctgtctagagtgcagtggcaggatgttggcccactacagcctctgcctcttgggttcaaacgattctcctgcctcagcctcccgagtagctgggatttcaggcgcccaccatcacacccagctaatttttgtatttttagtagagacggggtttcaccatgttggccaggctggtctaaaactcctgacctcaagtgatccaccctcctcggcctcccaaagtgctgggattacaggcgtgagccaccaaccagcctgaaaaaactcttatttatttatttattttttattttttaagagatagggtctcattctgtcacccaggctgtagtgtagtggtacaatcataactcactacagcttcaaactcctgggctcaaaggattctcccacttgagccttctgaatagctaggactacaggtacatgccactacacctggctaagtttttttatttttatttttgtagagatggggtctatgttgctcaggctggtctcgaactcctggcttaagtgattcttctgccttggccacccaaagtgttgggactataggcgtgagccaccacgtccagccccaaagaactcttataatcaacaataaacccaatttaaaaatgggcagaagatatgaatgaacatctctccaaggaatatataccaaatggccaataagcacatgaaaatatgttcaactttgttagtcattaagggaacaaatgcatagcaaaaccactgtgataccacttcacacccactatgatgactataattttttaaaactggaaaataggtgttggtgaggaagtacagaaactggaactctcatatactactagcaaaagtataaaatgatacagttgttttggaaaacattttgacagtttctcaaagagttaaacatagagttactatatgacctaccaattctacgtctaggtatatacccaagataattaaaaacatatatccacacaaaaacttgaccttgaatgttcatagcagaattactccaaaaagtggaaacgatgcaaatgtctgcaggcatacctcgttttattgcatttcaccttattgtgcttcactttttttctttcctttttttttttttttttttttttacaaattgaaggctgtggcaactctgtgtcaagcaagtctagtggcaccactttcccaacagtatatgctcactttgtgtctctgtgtcacattttggtcattcttacaatatttcagacatttccattattatcagttatggtgatctgttatcactaatctttgatgttactatcgtaattgttttggagcatcacaaactgtgcccacagaagatggcaaactcaataaatgttgtgtgtgttctgactgctccaccaaccagccattccccacatctctctccctttccttgtgcttcactgttccctgagacacacaatattgaaattaggccaattaataaccttgcaatggactgtaagtgttcaagtgaaaggatgagtcacatatctctcactctaaaccaaaaactagaaataaattaagtttagtgaggaagacatatcaaaagccaacacaggctgaaagccaggcctcctgggccaaacagccaagttattaaatgtaaaggaaaagttattgaaggaaaataaaagtgctattccagtgaacacataaactataagaaatcccagcactttgggaggccaaggcgggtggataccgaggtcaagagattgagaccatcccggccaacatggtgaaaccccgtctctactaaaaatacagaaattagctgagtgtggttgcgtgtgcctgtagtcccagctactcgggaggctgtggcaggagaatcacttgaaatcaggaggcggaggttgcagtgagctgagatcgcaccactgcactccagcctgttgacacagtgagactccgtctaaaaaaaaaaaaaaatgcaaaagaggccgggtgcagtggctcatgcctataatcctaacactttgggatacggtggtaggcagattgcttgagcctaggagtttgagaccagcctgggtaacatgacaagaccctgtctctacaaaaaatacaaaagacaaaacaaaacaaaacaaaaatttggtgtagtgttgcatgcctgcagtcccagctattcaggaggctgaggtgggagcatcaccacttcagcctaggaaatcgaggatacagtgagctgtgatcataccactgtactcctgcctgggtgacaaagtgagaccctgtctcaaaggaaaaaaaaaaaaggaaggaaagcaaaacaatgttattgctgatatggagaaagttttagtggtctggataaaagagcaaaccagccacaacattcccttaatccaaaacaaggccctaattctctccaattccatgaagtttgagagagataagaagctgcagaagaaaagtaggaagatagcagaggttggcttttgaagtttaaggaaagaaaccatcaccaaaacatgaaagtgcaaggtgaagcagcaagcgctgatggaagctgcagcaagttatccagaagacctagctaaggttattgatgaaggtggctacacgaaacaacagactttcaatgtggacacaacagccttctattggaagaagatgccatctaggatattcatagctagagaggagaactcaatgcctccctttaaagcttcagaggacaagctgactctcttgttaatggctaatgtggccagtgactttaagttaaagacaatgctcattgaccattctaaaaattctagggcccttaagaattatgctcaatctactctgcctgtgctttataaatggaacaaaacaaaacctacaaaacagcatgtctgtttacagcatggtttactgaatattttaagcccactgttgagatctactgctcaaagtgaaagattcctttcaaagtattactgcttattgacaatgcacctcatcacccaacagctctgatggagatgtacaaggagatggatgttgttttcctacctgccaacacaatatccattctgcaggccatggatcaaggagtcattatgactttcaagttgtcttatttaagaaatacatattataagactacagctatcatagatagtaattcctctgatggatcttggcaaagtcaatggaaaatcttctggaaaggattcactattctagatgccattaagaacattcgtgattcatgggaggaggtcaaaatgtcaatattaacagaagtttggaagaggttgattccagctctcatggatgacgtggagggattcaagacttcagtggaggaagtaactgcacatgtggtgaaaatagcaaaagaagagaattagacgtggaacataaagatggaattgagttgctgcaatatcatgataaactggaacaaatacaaataaggagttgcttctttttttttttttttttttttttaacagagtctccctctgttgcctaggctggagtgcagtggcacaatctcggctcactgcaacctccacctcccgggttcaagcgattctcctgcctcagcctccagagtagctgggactacaggcgtgcaccaccacgcctggctaatttttgtatttttagtagagacggggtttcaccatattggccaggctggtctcgaactcctgacctcatcatccacctgccttagcctcccaaaatgctgggattacaggcatgagccaccgcacccggccaggaattgcttcttatggatgaacaaagaaaatagtttcctgagatggtatctactctgtgaagatgctgaaaacattgttgaaatgacaacaaaggatctggaatattacataaacttgttgataaagcagtggcagggtttgagatcattgattccagttttgaaagaagttctactgtgggtaaaatgccatcaaacagcatcacatgctgcagagaaatctttcatgaaaggaagaatcaatcgatatggcatactccatttttgtcttattttaagaaattgccacagccactccaaccttcagtaactactaccttgatctgtcagcagccatcaacatcaaggcaacaagaccctccaccagcaaaagaattacaacttgctgaaggctcagatgatcattaccattttttaacaatattttaaaatttaggtgtgtacattgtttttagacataatctattgcatacttaatagactacagtatagtgcaaacataacctttatgtacactagggaaccaaaaatttacgtgactccttttattttgatggtctggaactgagtccacagtatctccaaggtatgcctatattgactgatgaataaacaaaatgtggtatagccatacaatggaatattgttcagttacaaaaaagaataacattctgatacatgctacaacatagatgaaccttgaaaatattatgctaagtgaaagaagtcagacacaaaaagacaagtattatatgattccatttatataaaatgtccaggatagtcaaatcaacagagaccaaaagtagattaatggttgacagaggctgaaggtagggaggaaatggggagtgactttaatgggtacagggttttttttagataaagaaaatgttctggaattagtggtgatgcacaaccttgtacaacctttttgcaatatagtgcaataagacaatattgtacaatcttgtttatatactaaaagccattaaattacacactttaaagggggtgcattttatgacatgggaagtgtacattaaaaataaataactattccctagcaagctgactaaaaataataaaaataaaaaatatattaatacataaataagtaagctaggacaatgggatgaactaaaactgaatgtatgaatatccaagatctggcacttaatgtacttccggttcctaaagataaataactggagaatgctggggttgaagaagacgcccaaatgttttccccacaacaaaatgtttaaacctgaaatcagaaactttaaaggagaggctatactaatgttacatatagcttccagatcatctcaattttgcttcatctccctaaacaatatgaagacaaaatttagtggtttcatttgatttgtgtcacaatctttatctttcttaaacaacatttcagctgtaattagtgttttggttgtattaacatcccttctatctctcaatttctttgctttgtctctcccaaacaatatttagctgaaaattagcattatcattccattcatattccttctgtttctcatctccctgaaaattttggttacttctcaatgccctatctccttcataagtccctctagtcacttttttcttttctttttcccataatcagcttgttcttgctcctagtaattccatgttatttttctaaaatacctttctgttgttaataaactttcctatactcctagcctttccttaacaatcctttgattgttaaggaaatcataatctgatgttctgctggttctatattagggttttcaggcccttactctcgtctactcccccactgaagttcacatcctcttgaaacatcactttctccccatcctcagctctaccatttgctgaccttcataccacactctcatagtgattaaagatttgggcacagaattatgggtatttctgtctgttctgagtcttatcatcccagattacctttactgtaaggtaaccagtatttatatttctaatatccaatgacatagtcatacaacatattagctttaatttatttatttgagaaagagtcttgttctgttgcccaggctggagtgcagtggcgtgatcatggtttactgctgccttgatctcctgagcccaagtcatcctcctgcctcagcttcccaagtagctgggaccacgggcacatgccaccgcacccagttaatttattttcatttttttgtaaagatggggtcttcctgtgttgcccaggctgttcttgaactcctgggttcaagtgaccctccctccttggcctcccaaagtgctgaaattacaggcatgagccatcatgcctggcccaacttcttaaaagcactagtcttcttgaattctctttgtctagtctgttagctccttgctgattttatccttccttgccagtttggatttatgagatcagttgtttcagctacattcttactagcactcataattccttccactccatgaccttaatacattgcatctcttctgccaatctctgaatgtgaatcaactcaaccatctgctttttccaatctgctcttggactgccaagaaaattgcataactgtgctttctactttatagcattaattatgatttaaccacagctagttggtttgattacccatttcctatagtagctatgtcaaatattcactactgtcctcaagccactacttcatgccatcatcctctctccaagataatcaagtcctatgttttaccgcaaaagtagatggcacaatgtctgaactccatcagagctctcaccggaaactcagccatctttcctcctacctgagaggatactcaaagttttctaataacatccctctatttttgcttttgatatgagattttgctccataagttattgtgtctcttctttcttcaatttcactatctacttcctcttgctctaaaaatatgctaacattttttgtatcttaaaaaaaaatccccttaatactgctgtcctacaaaactactgtcttccatctccttcccttcatctataacttcctgaaagaattttctacacttttctatttttatataaaagtcccattcatttctcgagatatttggcttacataattccaagggacctgcactgaataatgttcatagtgacctcctaattgtaaatcctattttttttttaaatagtactttcttactctagtggattgttctaggattggacattgttcaccacaaaccacttggatagaaattctcccttctcttggattctcttctagttttgttttgttttgtttctaggtttctttctaggtttttctttacgtcattctcttctagtttttctcctacctctttttccacccctcttcagcctctcaatattatctttcttttgttgtttgtttttatgtttaaaatttttttgtagagacagggtcttgctgtgttgtccaggctggtctcaaactcctggcctcaaatgatcttcctgcctcaccctcccaaagtgctggaattacaggcatgaaccaccatacctggctgatgttatctcttaatctacctctttgttaaacatttagtttcttattgtttcttagttgatatcttttctacacactctttctgggtaatgtcatccattttggtgacttttttttttttttaagggtacagttcagtagtggtaagtatatggacattgtgaaacagatctccagaatttttctttttttttttttttttttattatactttaagttttagggtaagaatttttcttagtacagaacaaaatgaaaagtctcccatgtctacttctttctacacagacacggcaaccatccgatttctcaatcttttccccacctctcccccccctccactccacaaaaccgccactgtcatcatggcccgctctcaatgagctgttgggtacacctcccagacggggtggtggccgggcagaggggctcctcacttcccagtagggacggccgggcagaggcgcccctcgcctcccggacggggcggctggccgggcggggggctgaccccccacctccctcccggacggggcggctgcccgggcggcgggctgacccccccacctccctcccggatggggcggctggccgggcagaggggctcctcacttcccagtaggggcagctgggcagaggcgcccctcacctcccagacagggcggctggccggacgggggactgaccccccgacctccctcccagacggggcggctggccgggcggggggctgaaccccccaccttcctcccggatggggcggctggcctggcgggggctgacccccacctccctcccggacggggtggctgccgggcggagacgctcctcacttcccagacagggtggctgccgggcggaggggctcctcacttctcagacggggcggctgctgggcagaggggctccttacttctcagacggggcggttgccaggcagagggtctcctcacttctcagacggggcggctgggcagagttgctcctcacctcccagatggggttgcggctgggcagaggtgctccccacatctcagacgatgggcggccgggcagagacgctcctcacttcctagatgggatggcggccgggaagaggcgctcctcacttcctagatgggatggcggcggggcagagacgctcctcactttccagactgggcagccaggcagaggggctgctcacgtcccagacgatgggcagccaggcagagacactcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccgtctgcaatcccggcacctcgggaggccgaggctggcagatcactcgcggttaggagctggagaccagcccggccaacacagcgaaaccccgtttccaccaaaaaaatacgaaaaccagtcaggcgtggtggcgcacgcctgcaatcgcaggcactcggcaggctgaggcaggagaatcaggcagggaggttgcagtgagccgagatggcagcagtacagtccagcttcggcttggcatcagagggagaccgtggaaagagagggagagggagaccgtggggagagggagaccgtagggagagggagagggagagggggagggggagggggccagaacttttcatcttgcaaaactgaaaaccctataccccttaaacaacaacaacaaaaacccgttttcccctccctccaggccctggtaactatcattctactttctatttctataaatttgactactttagatatctcctataagtgaaattatacagtgtttgtctttttgtgactggcttatttcacttagcataatgtcctcaagtctcatccatgttgtaatatgcaacagggtttccttttcaagtctgaataatattccattgtatgtgtataccacattttgtttattcactctttgatgggcacttgtgttgcttctatgtcttagctattgtgaatagtgctgcaatgaacatgggtatgcaaatatctgctttcaattcttttgtttatatacccagaagtgaaattgctggatcatatagtagttctattagtattttgaggaagcaccatagttaactttggtgactttaactaccatatgtgcagctaacttccaaatctatatcccttgccttaatctgtctcctgaaatatactgatatgaggcccaaaaggagggaaatatgttttatctttgtatctcttgtttttgtatctacttgtatacttggtatacaagtagactctaaataaattcttgttgaagaaactatgcctttttaattctgagtgtgagggagctaaagtccaaatttttttccattgattattgtgtaaatcactgttgtaagcttcttaatgatggtcactgcgcagtatacttacctgtttggttataatgcctaccagtgctttacacatacaaggtagcaagtatctcactcattaaatctagtaataattgcaaatatttatcaaactgagtagcagtggttcagtattgaaatgcttgcaaaatttctctttcctgtttctaaattaaaacataaggggaaaatatgggaattaatatggtatcatgataatcctatacatattttaggataaacacaaatctgtgggccatatagtgatgaacactttctggtcataagacctcagtaaaatagaacatgccgataaaattttcagaaaagtctaggaaatagcaaatttatatcaccactggggggaaagggattttttaaaaaaaaaccttgttgaagcatatgggcactcactattatttatgagatgatagcaagtgtactgagtaacattttaaacaatattctgaaaacatcttgaaacaaaaattcagcgcagatttataaagcaaaaaaaagcaatctaacaccaacgtgattgaggacacaaaatttaatcattgcttaaagattatcagatatttctctttcactattgaacggagatttaatacttgcagtaacttctgccaactcagaaccctgagaaaataagtcactttctttacagaaataagaagaaaaaaaaggatattaccaacaatggaagaggaatgcagagtggcaacagctccaagtggacctggcagactatgaacactagaatcaccaaggaaacatggagctatgaaatggcaaaaggctgtgtgaaaaccctgacgctttttggttcagcctttaaaaaccaaatgaaaactcaagagatacaagaatgtggttattttgatgaacaactcacaaactagttgaattaaaagaaactggttcaaatgaacacaaacctaaacattttttcagttcgtctaattaaagtctaaccaattccttctaatttaaaagatccagttttggatatatccaagactaaaacacaatcttatcaaagtctatttaatatggtgtaaatctcacgggaactgtgactatcttctctcccagtctaaaccttgtggcttttctgattgctttttataatgattgatgttcatatctctcgcttattttataagaaataaagaaaacaaagatcataaactcacacacagaaaaataaaagacacagttttttgtttgttttgttgagacaaggtctcactgtattgcccaggctggtcttgaactcctgggctcaagtgatcctcctgccttggcctcccaaagtgctgggattaccacacctggccagcaatacatttttaaatgaagattcactaccctagccaaaagtgtcttctccttctgcagctattttattaataaaactcactgatagcattgtccagacatcagagaccacatactacctagtgcatttttgtggctaatgtgtcccctactagatggtaaattccttggggctagtgatcatatcttaaacatttcacacagcccctagctacactgctgacctgcagattataaagaccacaacatttaagtggaaagcaagtatccattatgcagtattaagcaaatgttagattttcaacatatgggttttaaaaggcaaatatgtatataatgaaaagaagtaaaagccctgtggctgggtggggtggctcacgcttgtaatcccaaaactttcgaggctgaggtgggtggatcacttgaggtccggagttcgagaccagcctggtcaacatggtgaaaccccatgtctcaggatggggaacatcacacaccggggcctgtcgtggggtgtggggaggggaagggatagcattagaagatatacctaatgtaaatgacaagttaacgggtgcagcacaccaacatggcacatgtatacatatgtaacaaacctgcacgttgtgcacatgtaccctagaacttaaagtatagcaataaaaaaaaaaaaaaaagaaaccccgtgtctacaaaaaaatacaaaattaggccaggcgcagtggctcatacctgtaatcccagcactttgggaggccaaggtgggcagatcacgaggtcaggagtttgagaccagcctgtccaaaatggtgaaaccccatctctactaaaaaaataaaaaattagccaggcgtggtggccagtgcctgcaatcccagctactcaggaggctaaggcaggagaatcacttgaacgtgggaggcggaggttgcagtgagccaagatcacaccattgcactccagcctaggcaacagagcaagactctgtctcaaaaaaacaaaaagcaaaaaaaaccaaattagccaggcatggtggtagtcacctgtaatcccagctacttgggaggcttaggcaggagaatcgcttgaagcccagaggcagaggttgcagtaagccaagatcgcgccaagatcgcaccaagatcactccagcctgggcgacagtgaaatgtgtctcaaaagaaaaaaaaaaaaaagaaataaaagccccgaggactttcagaatgtaatcagaagaaaaaataatgcaggcattgagcaaactaaacttaaaagatggtcatgtttgctcatagacataccttggggctgctaaggaaatcagaagaatgccaggaatagaaagtgtgccttagcctatctacattagtacaaggttgaagtaaacagtctctcaaagttggagccaagggttacattttcgctagtatgatcagacattttctaaaaaaactccataccttcccttaaaacaaaaaaaaagcccacaattactttcccaacctcaaatgtttatggcaataatagctaatggttctcagatactgttatacagggtgtggtgcattctccacataaattcttcttttcacattcagataaaaggctgatgtaataggtcaaattttattaagcttcttaagagaaaaatgctgactaacccagtgtgaagaattcattcacatggaaaagtccagtaaaaagaagtagggtcatatttatcttaaagttggctatttgtgatgtatcccacataactgctttattttgtgattaaatatagaagggttttaataaatcttgtttcatcaaaattcatatttgtaaacaaaataaagatatttttgcatcatagaaagtttgctttatgaaaagactcaaatataggtttgtttgtttgtttttttttcttattttgagacagagtattgctctgtcgcccaggctggagtgcggtagtgccatctcggctcactgcaacctctgcctcccaggttcaagtgactgtcctgcctcagcctcccgagtagctgggattatagacacctgccaccaagcccggctaatttttgtatttttagtagagacagggcttagacagtataatggtaggcagatataatacagtgtaaacacactgtactatgtacactaacacactatactatgtcttcctaccattatactgtctctgcccaatattacttattctcttgcagtcgacatattaatataaaaaattaaagccaaagtacttaatcttataaaatacatcacaagcatcaggagtggcacaatcataacgccaaaggtggtagaggcagaagaaattactatggggtcagaagagactgagtaatgatggatttagagtacagaaaagggcaagttaggtaaggccatgatctaagaaaaatataaatagggctatactggaaaaatacaaatagaggtatactgggagtagcgggagaaaaggtgagacagttgagctggagccagattataaaccgtgataccagccttagaagcctgggcttcattctggttaacagtggttctgggattccagtgtacacaagaatcatcttggggagagactggtgactagacagattttaactcctgagattctaatttagtatgtttgggatggtcccagaaaactgcatcttaacaggtgattccagtacaaagacacactttgagacactccaccataggacaaatgattaagaaactctactattaactattgcaaatatgccaattccccatatgctgtgaaaatattcaattgcatccaatttttctttgttatttggcactgactttgtcactgtttacatcttgagtgaatttgtttaacaatgcgcttttcggggtaatatccacgatctacaaagaacttaaacaaatttacaagaaaaaatcaaacaaccccatcaaaaagtaggtgaaaaaagtaggatatgaacagacatttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcaattcctcaaggatctagaactagaaataccatttgacccagccatcccattactgggtatatacccaaaggattataaatcatgttgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaaggatgagttcgtgtcctttgtagggacatggatgaagctggaaaccatcattctcagcaaactattgcaaggacagaaaaccaaacaccgcatgttctcactcataggtgggaactgaacaatgagaacacttggacacagggtggggaacatcacacaccaggggctgtcgtggggtcgggggaggggtgagggatagcattaggagatatacctaatgtaaatgacgagttaatgggtgcagcacaccaatatggcacatgtatacatatgtaacaaacctgcatcttgtgcacatgtaccctagaacttaaagtgtaataaaaaaattacaaacaaacaaaaaaaaccaatgcgcttttctggttctctgactctctgaaatctctatcgtctcctctggcctctcatactttgccgtttctttacatgttatttcttaagattctgattttagtcctctacagatctccttgagtgatttcattcactcctaaggcgtatagagaatgctgatgccaacctcagaagattagactttgtcctgtcgataaagaggagttatagaagtttctaagaagtagaatatcatagagaaagacatgttctgggaatataaccttggagatggtctgcagaaaaggaatggggataggagaaacaggaggtagggagaatagttatgaaactatcaaaataactgtttaaagtcatcaccaagggatgacttcaaaacgaaaatgttacttttctagtagttcttccctttaagaaactagtcttatttcaataaattaataggcaagacccttctaaggacattggaatttcattatcttttttttttgctatacatttaactataatataacaaattaggtcctctgcaatgttaatcacagatagtaaaaatctgacatgacattgttctattataacatcaatgtgagttcttttctaaaacaagtggcatgaaggattttatagtattgatattgatatctgataaatttagttctttcattatggagtcaagaaatcatcactagtacagatactattcagaaataaatggtataccttcttttatgacttgaactcatgaaagaatggtaaaagtatgtttgattttactttatatgaaagtactcaagctattacaaccatatccattgtgtcttatacacaatggaaaatatagtattttctataattgaatccagaggtttctaaattggcagataaaatagtacctgtatttagatattctatttgaaacatgctttaatcttaggaaaacagaggcagaaagcacctaaattaggtgcaatcctgtctgctcctaatttagaaaataaaccaatttattggctattctttctcaagtgatccacattgagagatgctaggtctttatcaagatcaatttcaaaattttttttttttttgagacggagtcttgctctctcgcccaggctggagtgcagtggcgcgatctcagctcactgcaacctctgcctcctgggttcaagtgattctcctgcctcagtctcccaggtagctgggactacaggcgcccgccaccacacctggctaattttttgtatttttagtagagatggggtttcaccatgttagccaggatggtctcgatctcctgacctcgtgatccacccgcctcggcctcccgaagtgctgggattacaggcgtgagccaccgcgcccaggccaatttcaatttttaacaactgtcactacaagaaagtcaagaaaatagaaattagtcctccctcttgtgtgaccttggggaaattccttaagcattgtcttactttccacagcgctatcctcatcatacatatactgtgaagataaaatatctgttgaagattctttgagcaccttgggccagaagagctacagaaagccaaggtatagttattttcatatccacgacttcatttgccttttcccttgttgtagcctctctggaaattaagcaaagatgcctatcaccttctgcttaataacccttcatgtacttgaaattgttattctccccaggtacctcaagcacattttttaaagaggattgcctaaactctaaaacagcaatcaagggctatgagtcagcatttcacctagacataaaatcaaaatggtttaaaataggtaacattatctttttgaaatatgtacatacctctttggagaaactttgagacaactggagtttgcaagtttatgaatagtttattacatttcagtaagtgtattgtgaatcaataaagcaaaagttaaggacaatgagctcattaccaagccagttattgattctctggttccaaaatagaacagtacaggaagggtatagagaaaataggatttttcatgataaaaattttaagcatcttaggaacacagacctaaagaaactataagacacaacggaaatttcagcagctacttaggatgtttatttatttacctttttttgccaattagaattagttatttggtttttactcttaaaaaaaaaaagtattttcaactcaagtcagaggagtttgccaaaactgaatattacctcttactgacttaattattctttcaatttcttgtatatcttcctctcttgcctttgaaaagtttaccttactagctgtctatcttatatcactgtcgtagctcagactgccctaacaaaataccataggactgggtggtttaaacaccagaaatttatttcctcacagttctggtgattagaagttcaaactcaaggtgtcagcatggtctgtttctggagactactttctttctggcttatatgttccaggatgggatggttggaggagccccatctccagataccatcacattaataagggcttcaacatataaattttggggacgggaacatctagtccaaaacattcactaacagaaaaattgacactggctccatatcatcaagcagataatatggaaatgaacaagtcaatttgttttcaaactattcttatgggaagcttccctttttctcccttttacagcaatctaattcaatggaaaaggaacttcttaaacaatttatgaactaacactaatttcatgaaccagttctttaaaaagcgaagacaaaaagtgagacacatgattttggtaaaaactgaaaaatagaccattaacccatttatatagtatgtttaataaaaacaacttttaaacccttatactttgttcttatatcaagtaaagattcttaaagtaatgtaaaacatttgaatgtccctggaaagtaatataacacacaataacccttctatattacatatatatctatatgtatatgtatatgttagagactgggtcttgctattctgcccaggctggtcgcaaactcctgggctcaagtgatcctcccacctcggcctcccaaagtgctgggattataggcatgagccaccacatttggccctatattacattttcatgcatattattaaaagaaatggtgacttacatatggaaatacagaaaactgaaatagtaaacaaaattaacaaagttataattgggttgtgctgaagtttacctaattttaatacaaatagttatttttattacatgctacacaaatttgatggtataagaaatgtgtttttcttgtttgcatgaatttcttcattgcaaaatacttaaaatgtacataatttttaaaaaacaactaagaggccgggcacggtggctcatgcctgtagtcccagcactttgggaggccgaggtgggcggatcacgaggtcaggagatcgagaccatcctggccagcacggtgaaaccccatctctactaaaaatacaaaaaaattagctgggcatggtggcatgcgcctgtaatcccagctacttgggaggctgaggcaggagaatcgcttgaatccaggaggtggaggttgcagtgagccgagattgcgccactgcactccagtctggcgacagagcaagactccatctcaaaaaaaaaacaaaaacaaaaaaacaattaagaacatttccttaatgactatgaagtgaatagacagcatatttcaaattttcaagtagaagggtagaggaatgtaggacaaaaggtgactgagatccagagtttaggtgacttggcaaagtcatccaattagcaggtgcagagttatatatgaaacccaagattttcctgtctaaaaatgctgaagattagtatattcaagattaaggggaagaaaatctaattatactttagatcatttcataccagaaaacagctatagaaactagtttttcattttcaaaactcaattaagtgtgtgaatggtccgttggtgtccagctttaacacctgcctgttcccataagtgccatgttccactacaaccctagcttcagcacacttgctattagcagctacttctttttcacatagagtcacaaattgagagtaaagttcaaacccttcttcttttccagagttagagtgatattgcatgtttcttccttttagtcttcctccaagggtagcttgagggataataagaatgttgccaggtagatccaatatagagacatgcttgccattttctgtctcacttaatttcacatttaacagtgtattaactgggtgaggaagaaaggcaaaacattttaaagtgaaaaacaaacatgaagaaaaccatcaagtttttagtcagcaaatctcatgtttaaaattcagtttgtcagctcatgcctctaacccaaagtctctatttagatttaaaatactgcttcactaagctaaataatctaagcatgaaaaataaggcaattttcatgcagaaaatggcatgatattttaaatctgaattggcagttaagataacctaacaataagttcatccagaaaggtctaaagaattaactgtacactggaacctcaaatattgttcccctgggggaatacatgagaagattttaccttcctgttctttttatttagtaagtaaatcccactggaaaaatatgaggataactcctcctcacaccaaattctgcttgcttgcttgcttgctttatttatttatgtatttatttagagacagagtctcactctgtcgcccaggctggagtgcaatggcgtgatctctgctcactgcaacctctgcctcctgggttcaagcgattctcctgcctcagcctcccaagtagctgggactacaggtgcgtgccaccacacccggctaattttttgtatttttagtagagatggggtttcaccatgctagccagggtggtctcgatctcctgacctcgtgatccactcgccttggcctcccaaagcgttgggattacaggcgtgagccaccacgcccagctaaattcttctttataatggaatatcaaataacaattttagcgcagttattattttaaacttagttgccaagagttttaagcagagacaaaggttcctgtttcaatcccaatataaaccagctaattttgttgtttaataaccttaaaggcaatatgaacatggactaatcattgtataaatattactcatgagagaagggtaaaggtgaaagcaagaatcatcagaaattcattgttacaactgaaaaagtaaataaaaagatataaagctatggcattatcttcatacacatatacgaaaacgtgatattatttttgtagcattcgtgagatttcctatagctaataagaagtgtcgaaaccaccataaatatccatatatagctaaaagcctaaacttagaaagcctttatacctcaacattaaccatttttgaaacaataagcaaaagaagtgtctaatataaatagacctagggtctccctacctctataaaggtatacatgacttctgtttgcaaagaatagtcctgagagggcaaatggtagaaggaactacataaacttcaagacacctgccctcaaattaggcattaaaaggcatgctttctgttggggtagctaacggttttaattattagagggtctgtagtaagtattcatatggttacccctctctacaaatcatggaattaatctggtaaaaacctgccaaggcgaacacccaaatgaattcctaagctaggcattaagcatcatcaattttcacttaactaacatttatttttaaatacctctagttttctctattacaaataggactttgctgtttagccagcagtctttattgactgcttgtaaggaaactttccagggcacttcattccactcgaaatcactatctagctatctaggcctccagctagtgacagagtaaataggcaattttggaataacaggcctgagaggtaatgctacaatttattatgtttccacatacctccctctactggctataattgagatttcagttaatgctgttggcatacaaatatcagtatgtagataaatacaatgtagaaacagtaagtagaattaaaacgagacaatgaattaatggcatgctggaaactcaaatatcctaaaacaggttatcaatcaagtatctctaatgatgtataggagatgttaagctttgacaggtttcttgccctctctgtccaattatactgaaggtgaattgaggaagattctacacatctctatgttaaccatgctatttcagattttgcagatttaactggttattatattctcaagtgatatatgctttgattggaaatatctgaatctatgtaataaatatgaggtgaggcttaagagaatcccaccacattgacttacttagcctgctggaatagagggaagtacaagctaatactattaataatagatggacttactttgcttacaactcaaacgagtagaatatgattcttagagtcatatatttctttactgaaaatcatgatataaaaaatcatgtgttagatagtgtcagaccatccacaagagtcagggtggacctcctcagtgttttaaattcactacaatcttatgcatgtatttaaagtgaactcacaaagacagatatggaagcacacaggatttaatcactataaaataacatgtggtttggatatgataggcatatttcatcctattatgatgaagaaccatttgagaattcataagacaactttatgaagtcaatcttaagtcagaatgacaaatactttcttcctgtttttgaagatttctacattttttatggaccaaaaaagatttaatccaaggcaaaatattaatttaggaaagtggacagaatgtgtaacactccagcattaggatctgacaattattctctgtaataggagtcctcattacattatgttcttttttttttttttttttgagatggagtctccctctgtcgcccaggctggagtgcagtggcgtgatctcggctcactgcaaactccacctcctgggctcatgccattctcctgcctcagcctcccgagtagctgggactacaggcgcccaccaccacacccggctaatttttttgtatttttagtagagacggggtttcaccatgttagccaggatggtcttgatctcctgacctcgtgatctgcccacctaggcctctcaaagtgctgggattacaggcgtgagccaccgcgcctggcctctctctctctctctttttttttctttcttcttcagaccagaacattatgctcttaacccatcagaggttccttattatcttctggattcaaatttcaaactattgcagttactggctttccattctcacctagcatagtctcttaagtctggttttcatcttttgacaaagttgtcagacatgtttgatatgtcagtataaaattccctctaggagttttagctttttgtctaagctcttcctcattggcctatttgcccttgaagctcttctaggttttctgtaagcttcaactgcccatttgtataattaatatttcttattaatccaacttattaatggatgctgtcctttactaatgaggagaatacaacctgttcccaaccttaaggatagcttttctttcaagtttgtatgtatgtttgtttgtggatataatctttatatccaaatactgtcctgagagggtatgatttgatttggtatatctgaacctatgtaattatcacatgaattgctatagctatgtgagatagtgtatatatacatatcactatacagtgctatagcccgtccaggaaaccagaaagctgcaggtaggtaaattactattcagagatccctaacattgactctgttttccatgtccttggaggaggtgtggctgtgatgacactgaattcagctcaagacccaggagaaccttacatctattcttatttccacaaggaagtgcacacatggctaatgcaaattcttccataataatgatataaacttgagttgtccaggtttgatgagacccacatcttgtatatacagtgtcatctactgcctctgttaggggctctaggggataaaggaaactatattaagaaatgcagcatctgtttctccctgtgtgaccaccctacttccaagaagtttctgtatccttggctgaagtgcactgtgtgtatgtgtatgtgtgtacactcttctacatcaatctgtaagtcactgaaatgctgcagatgttttaaaaaaattccaccatacttgcttactttaaactttgaaacaggcaaatagctaaggccaataacactagatagaattaagtaattaataatttaacagcacaatttaacattgtgcttcttaggatgggcagggattggttaatggatacaaaattatagctagataggaggaatgagttctggtgttctggagcactgtaggatgaatatggctaactataatttattgtatactgtcaaaagtctagaagaaaggattttaaatgttcacaacacaaataataaatttttgagataatgcatatctggtttgattgttatacattgtatacagtattaaaatatcactatgtatcccatgaatatgtaaaattattatttattattttaaaaataaaaggggaggaaagagattgtgctttttgtcccttcgggttcatttgtctattactattctttctcactctctttttttttttttttttgagacagggtctcactctgttgcccaggctggagtgcagtggcaccatctcggctcactgcagcctcgacctcctggcctcaagtaatcttccagcctcagcctcctaagtagctaggaccataggcacaggtcaccgtacccagctacttttgtttattttttgtagagaagaggtcttactatgttgcccaggctggcttctaactcctgggttcaagtaatccacttgccttggcctcccaacgtgttgggattacaggtgtgagcaccatgcttggcctctcactcttaaaaaagaaacaaagtcaaacacatacccattttgggaagaagttctttatcagctcccttgaaaaagcacacgtagatcaccagtcctctttggacctatgagaaatcaccacagtaaactcagattacaacaatatctgtaaagatacagggctaaatgggtacagtttcacaactattaatattatagacatagaggttaaaagcacagaaaatgaactttacaaaagatttctcatgtgagaaaacaaaatatttttcaattttcaatcatctcagttatttctttcaaatttaagtttaaaatatacccaagagcagtgaagacaagttataccttcaaacatttatttctaatcaaaatcattaagaggatcaaccagccttttctcaagtaagggtgacagacttagaaacatttcgtttgctgggccccatttattcaatgccaagtgaattcacattataccagatacagctgatggataaacaacatgtgactgatatcttttgacatcatctctctttatttcccctaatccatttacttacaaataatgaaaataagggtctgattctatttctataagctccaggaaactgtccaattatttgttgttgttgttgttattgttgttaatgctttatataaacatgattaggacttgaaaactgcatttgtgatagtaaattctacattaaaaggttggttgttatcaggaatataggcttatttattttacataatggcttggatatttcttagatcttgtaggacagagactatacagaaaagagacatttgaatagtgactttgattctgcttctgagtgaatcattagatttttttgattctgtaaattaatcttgactccaggagctattaggaagattaaatgagttaacatttgtaaagtacttaaacacagtgcctggttcatagtaagtgctatattagtgtttattaaatgagtatgtaaaaataaatttaagggcagaggcacaatttatttcacattttaacttccaaagcactttacaggctgttttgtacacgatagggattcagtttatctgttgattgcattaacattcaactatatgttccaggctctatgcgttatccaaagaattttctagataaatgtaaatgcagctctgcactcacacgtgatttacctggaaaagaagtgagttttaaaaagtacaatcgtgctactgaaacaataggcaagggcctccaatgcatacccacgagaagctggcaagttattataggtatttgcactactgtcacaggcctctccactagtattgttttcatcatgaatcgaaatcttaagcatatttatatttggacacatgcaatgtcagaaataaatacctaatcatttgcagaacgatacctgttctttccactaacattatctcctcattaaggtctttgcctttcatttattccataatagatgttaagctgtgacttcaagtcaaaaatcactttccttataacttctttggtataaaacatttcaaatatatagaaaaatacagataattctcactgtagctttaaaaagttcacttaccaggaacaaaaacattagtctgtgacagcaaagttctaaatgaatgaaactaagaacaagcaaagaaagtaaccttcaaatcttgacaattaaaatgctgtttctaaaaaaacaagaacttttaataatagaacagggtagagaatatgtaagaagaaagaatttacattttctcaccatctaaattacttgtcagctctttaaactaatttagttatgtgtgtaggagtgaaagggaaagcctttaaaatagtttttaagtttataaacacaaactgatagtttggatgccagcaataaaatacatgtgattttgcataaggagatgtagcctgaacaacataaaaaagataaataagcatggaaggaaactaaatgactgatagtttgcaattatagtgtctggatgcaactataaaaatggataattcggccgggcacggtggctcaagcctgcaataccagcactttgggaggccgaggtgggcggaccacaaggtcaggagatcgagaccatcctggctagcacggtgaaactccgtctctagtaaaaatacaacaaattagccaggcgtggtggtgggcgcctgtggtcccagctgcttgggaggctgaggcaggagaatggcgtgaacccgggaggcggaggttgcagtgagccgagattgcgccattgcactccagcctgggtgacagagtgagactctgtctcaaaaaaaaaaaaaaaaaaaggataattattttatttattatttatttttgagatgaggtttcactctgtggctcaggctggagtgcagtggcgtgatcttggctcactacaacctctgcctcccggattcaagagattctcctgcctcagcctcccgagtagctgggattacaggtgcccgccaccaagcccggctaatttttgtatttttagtagagacgggatttcaacatgttggccaggctggtctcaaactcctgacctcaagtgatccgccggccttggcctcccaaagtgctgggattaccgcgcctggcaggttaattctttagataggatggcaaaataaaataataaaatttcaaataaggaaatcaagacctcacaaaaaatcatgacaaaaataagaaataagaaaagtgaatttctgggaaaggagagagataagaatacaggaatttctatgcttatatttccaaattagcacagggcaacagattctgattttagaataatcacccacacatcatatagttcacgggtactatttacaataagtaggcggggtgcggtggctcaggcttgtaatcccagcagtttgggaggctgaggcaggtggatcacctgaggtcaggagttccagacaagcctggccaaaatggcgaaaccccgtctctgctaaaaatacaagttagcgtggtagcttgcgcctgttgtcccagctactcgggaggctgaggaaggaaaattgcttgaacccgggaggcggaggttgcagtgagccgagatcgtgccactgcactccagcctgggcgacagatcgagaattcatctcaaaaaataaaataaaatataaataaataaaatataaaaaataaaataaatgtaaaataataactaaaattgttttaagtaatgctagatctgggaccgaattcagcagaaaaggcgagcgaatgagattttgctacactgaagtttctgagtatctacaaaagtcttaattatgaactaatttttttcttacatttcaacgtactccaaaaatacgtcagaggccttaaagaaaattttatttgtttttgtatgcagtgggggcaggcggtcttaaaaagtaaagtatgtatgaaagtagaaggaactcatagtgacataaatgttttaaattctttggagaaatgtgtttgataaggcaacattgttataaaagtagaggtctttgtttctcagttggaaattggtcaaaacttttaaaaggcttcttgaaatagaattgtttcttaggaaatctcatttctatgctaagaccaagtcaacataggggggaattcgacgcgatctgaggcgtaagtcaaagcagatcatgaactcttgcagcaaacctgacctacaagcttgcccccgaccagcatagaccacgagctgcaaggggtctgagacagtaaggcctgaagttcaccgaactcagtttcaaatacctgtggtccccccaagaagggagacacgctcttcctctcgggtgctacaactggcgctggggaacggtgatgctggaccgaaaagacaagcgcagccaggcaggccaccgcggccagcttcaagctgacccggtatccccgcggccggaccgccggtctcagagggagacacagagcggacgagtcaccgagacaacgcggaaaaaaccgccccgcacgccggaggataacgagagctgccgggctgacgttacctccacccactgggccgcgacgtccccatcggctgggcgaatttgcagccgggcgtgcaggcactgctgtaggagcgcccgggcctgaggaatccggctaccctcagccatggcttaagccagcgccgcggccggacagttactaggccatgtgtcgctggcccctccctcgacgcgctggcggggcagacgaggcggggcacgacgaagggcctgcgccgattgcccagtggccccgcccttaggagggcggggcctcggactgactctcgaatgtcccggatgtgcggtcttggaggccggcgtagcgctaagcttctcggcagcacctgcccaactctgtagaaggcgctcagtgtatacttttattaaacgattgaaaagactcgttaaatctctttcctacaaaccttttaagaaacatttttcacctcagaaagcttaggttccaactgttgaaaaattttaaatctgcttgatttaaattcatgttatgcccatatgaaagtaagtaaacaaataatcgaatcataaagcaagcggagatggaactaaaagctatatatacatccttcaaaattttccttattccaatcaataaaaacaatgctgcctcctctatcgggaatgccataaattattctgattccacagttgtgaaaaggtattggtatgctatacgaatacacattctttagaagatatccttgttaaaaatgttcttatccaagaaagtatgattgttaataacttagcccgctactaatacaaaaataaaacagcttattctgatgcatatgacgtaaattctgtgatgcattttctggaagtacatattagaatgtaaataaaactaaacaagggcttgattttctttcccatgtaacgtattccttaaacatgcatcagattagcatttatttgtctatgggcttggatggtttagatgaggaataatagtgttaccctgattgcattacccaggtcattgatttgggctcagttgacacaatgtgcctatacattcggatctgttgtttaaaaagatgacatcactgacagtgttgctatccatacaaagtagtgtgactgaagaaaatagtccatgcataatcaacagtcctttgtacacaaaatcgaagctgcttgtttgctggttatcttgcagccaggtttacacttttagtaaaaacagaaagcaaaatctcacatgatctctgattgttgcattgcagggattccaacagttgttgacatttgtctgcaaagcacagacaagttgaattgcttcatgtctgcacctttatgtcattataactactgagtctcttttctctccggctctcagattcagattttacaggcctgaaagaaactttgacatacaaaccattagctatgtcccagaataagaaaagactttggtgtccatttgtatgtggctgcaggaaatagggaggtctatagagaataggttatgtggttcgcagagatctttctacagagagggtttctttaacaaattgggaaacccttcctgtgagtagaatagatggagtatggatggtaatggttagcttctcaaaaatcactaattactttaaaccctcctattgagtgaggatctcgtggacattgctgtaggtactgtaataggctgtggctcacttattttttacttctatttgcagaaggctatagagagtggccaccaaagacagcatttcctttctgtattttattttttgaacacttagtttcattctgcaaataatttaagaaggaaggacatgcatgcaataaaatagtaaaatgtgaattaaagcattagaaataaagaaactagaattatgtcagtaagccacaatgggggaaattgaaaacaggtaagacagtggttctcaactggagtgctgagatgatatagtatgcagcaaaattttcacaaatgtataactttaatttttgttataaaacaattatgttcattgtatgtagtattgaggtgctgtaggttgtacaatttgtttcaagttggaactaaaggcaaagcatagcattaagttggctttacaagaagatggtggttcactggaatgtgagagagctttgccttgtcattgtatgagaaatcattgagcagagataattctcaaacacctacaatgctgaaagtgtaccatatggataggggattaattgtggatgggttctatgtcctctgagatggtacaataactaatttagtgttattttaccttctttaattcatttaagttggctgccctaaattctggcattcaaagtatttcacaaacatgaaaagtttgagaaccatttctaaaagattccttagagttgatgctaagcttcctggttgtaaataggagaggatagggaagggcagtataatctatttcatagttctagggataagcagagcttttcctcagatttagctctcagctgagcctcttacctgagactttatataggatatgttaataaatacaagtgcaggcctggcgaggtggctgatgcctgtaatcccagcactttgggaggctgaggtgggtggatcacgaggtcaggagatggagaccatcctggctaacacggtgaaaccatttttagtctctactaaaaaatacaaaaaattagccaggcgtggtggcgggcacctgtagtaccagctactcgggaggctgaggcaggaaaatggcatgaacccaggaggcagaacttgcagtgagccgagactgcgccactgcactccagcctgggcaacagagcgagactccgtctcaaaaaaaaaccaaaacaaaacaaaacaaaaaaaaaccaaaaaaaaacaagtgcaactggaagaggtaggtatcttatcttagggaagacagtatctagccctctagtttaaagcccagatatttttttttctagtttaaagcccagagatttatttttttttgaaaaaaaaaataataaccaggttctgagaaattggttaacattaactaaaatgcacattagattggggtagaaccagaatactaatttagtcatttacaacaagaaatattgccatgacatggagtagaaattctcacatagggcatggtcagcatgtttccccctgtggtgaagcataggaagctagatcatattcagaagtctctttattaattaactatgagaaatactcaaaatcggtatgaccagcatattatttttatgtagagagagtaacacagaaatcaggatgttgcttggtaaatgagaactcgaacaaagagggtgagaaaatttttttgtggaagacacctaactatgaccccaagtactaagcacaggagacagtgagaaatatactaaactatgtccctacagcaaatgtagtatcagattttctagggcaatttctttaattgttccttgataaaatcagaatcccttgatataaccccacaataaaagcaagccttcagatgtaatatggtctaaatatactaatgtgacggtcctactctactagagattaatgcatgaactttgtgtacttcacttaatcctaatcaattttctcaactgggcttttgagaagtgttgaaccatgggatcgttcaaggtttagtccatggcaagggcttgtggagtagggtattttatattattgaccaagacactgtgatttagagatcaaaagagcaaacagggaggttacactgtatattgaaaagggaaaggccaaattaggacgtgcatttggatgaatagctatgctggttatatatgaaggtggatttaaggatttctgaaaaagtagttttgtctactataacacataaatgaaaaaattaggttcctaaagttctatacagtggcagatataattttggcttggaaaaattgtctaagcagttgtcttgacagaaaacagatggcacactttcaaaaggtgaagagaagctgagcatggtggtggctcatgcctgtaatcccagcactttgggaggctgaggctggagaatcatttcagcccaagagtttgacaccagcctgggcaagatggtgggacccccatctctactgaaaaaagaaagaaggtcgggcacggtgactcacatctgtaatcccagaactttgggaagccgaggcagatagatcacttcagctcaggagttcgagaccagcctggccaacatggtgaaaccccatctctactaaaatacaaaaagtagccgggcgtggtggcttgtgcctataatcccagctattggggaagctgaggtgggagaatcgcctgtacccaggaggtgagggttgcagtgagctgagattgaaccactgcgcttcagcctgggtgacacagcaagactccatctaaaaaagaaaagaaaaaagagaagaaaagagagagaaagagaggaaggaaggaaggagagaggaaggaaggaaggagagaaaaagaaagaaagaaagaaagtaagtgacgagaataagagagttgaaagaaggttgaatgaagggatcattaaccaggtatgtgaaaggttaaggaaaaccatcaggggatagtgaaggacccagggctagcaacaacaggaagcagttaccattctgaaggggtaagaggaaggaatagttttcttcaagaaccagcaagaactgtgggtcacacttgacaggacctgtgaccttccatagagaaatgcagcctctgccaaactgcagcctgttttccctctcctcctagctttgattgtctgccatttctctcattggctacacccagctggaagttagagtaagggttgattcagtacataaaaaaagcctcctgggacacagaataggatatagaaggatggagagtggatctgaaaggacacactgagaagatccagggcagcaactacttccagcttctatggacagagagaaatatcaatacttaccttctacaggataatttagtggcaaaatatacccctcatctgtatatccagttttctaattacaaggggctattttatgaagcaattatattttgggtgatagctgtaaagaataattattttattttgttttgttttgtttttcagaaaaagttccaaatcaataggtattttattacataattaaatatcacaaataaggctaggtgcggtggctcacccctgcaatcccagcacattggaaggctgaggaaggaggattgcttgagtccaggagtttgagacaagcctgggcaacatagcaaaaccctgtctctacaaaaaatacaaaaaaattagccaggcatgttggtgcgtgcctgtagtcccagctacttgggaggctgaggtgggagggttgctggagcccaggaagttgagtctgcagtgagctgtgattgttccactgcactccagcctgcatgacagggcaagactgtctaaaaaaaaaaaaaatcacaaatagattttaggattcattgggcatcttgtttcagaagctggaaaactcttagatcttattcatcagccggctgaacagttcctttttcagagacatagatgccatccaaaaattttctgatgtctttgattttaactgttgtggcttgctgaatcaaggcaactgaatttgaaacaagctcaatgtcatttccttcaaggattaattcatctttctgggcttgagatactgaacaaacaacatttatcctcattcgaaccctgcggatgtattttttacccaagaaattgtggatttcaacaagagacctgttctcccagaatacgatattgatgaggaagtgagcttacagagacttcatcttgtaatggaagcccacagtagcacccttgatcatgttctgtacatgactacaaatagtgtgaagggtagccagttcctttctctttccccacaagttgtcaacctggagcctcttccttttctttccaaggagactgagttctacattggtgtgattgaagtccttctgcagggttcttttggggcccttcacagtaactgtgtttcttcagagtgatatcaacattttctggaatgttgactgtctgattgctgagaatggtcttcattctgacagtatacgccgcaaagagagaatgtctcatcatcacattcttgtagcccataaggggattgtgtattcaagaacaattattttagcttaagaatatgggacaacaattatctattgaggtgaacacataatgctaataaaactacatttgtaaaagtgaggccaggcatggtggctcacgcctgtaatcccagcactttgggaggctgaggtggatggatcacttgaggccaggagtttgagaccagctggccaacatggtgaaaccccatctctactaaaaatgcgaaagttagctgggtatggtagcacagcctgtaatcccagctactcaggaggctgaggcaggagaattgcttgaacctgggaggcggaggctgcagtgagctgagattgcaccactgcactccagcctgggtgacaaagcaagactcagtctcaaagaaaaaaaaaaagtgaaattaagcttctgtctgttatcgcatcacacaaaaatgttacagaatatttaagataatctgattgggcctgtgcaaatttcactttaggggtgtccagtataatcaccgagagacagtcagtcttccactagggcatctgaaactgaggtgtgagaggcccatgtgaattctgacttcaagacacttgccacatacattaagactctgagggaaggccaggcgaggtggctcgtgcttgtaatcccagcactttgggaggccaaggcgggtggaccacttgaacccaggaattcaagaccagcctgggcaacatggtgaaaccccatctctacaaaaaatgcaaaaattaaccaggcatagcagctcacacctgtaatcccagcactttgggaggccaaggcaggcagatcacttgagctcagaagtttgagaccagcctgggcaacacagcaaaaccctgtctctactaaaaatacaacaatttactgggtgtggtggcacatgcctgtagtcccggctactcgggaggctgaggtgagagaatctcttgagcctgggaggcgaagggtgcagggagctgagatgacaccactgcactccaacctgggcaaccgagggagaccctgtcttaaaaaaaaaaaaaaaaaaatatatatatatatatatatatatatatatgaatacatatttatatacattatttgtatatatatgtgtgtgtgtgtatatatatatacatggttgtggtttgaagcatttgcccttgtacttttgatttcaggctcttatttaaatctgtttgtttcctcttccctcagagtcttttttttttgagacacgttctcgctctgtggcccaggcgagagtgcagtggcgtgatctcggctcactgcaacttttgtctcccaggctcaagagattctcccaactcagcctcctgagtagctgggactacagtcatgcgctactatgcctggcaaatttgtgtattttttgtagagatgagatttcaccatgttgcccaggctggtctcaagctcctgagctcaagtgatctggctgcctcggcctcccaaagtgctgggattacaggcgtgagccaccgccactggtctacaatcatatattttatcatagagctgtttcttaccataggcagagactgagtccaggagtatcggtcctgtggaagtccctccacatgaaaatataagacctagaaaaataatagtttccacctaatagctgactctatatttaagatgaatagtttgtataaccaggaaggagatggattttagattgaaacttaatattgattgttactttattcaatttgcttttttaattcttattttattactgcaacatttgctattgtgttgcctaggtaacataaacaagtgcttttaactctaaggcagtgatgtatatctttggcagtctgtagggtttcccaggggaggctgataaattatcttgatctttgggttatttttcagtttacagtgttgtaataacttagcaatgcattctatgatcttttgaatatttgtgtatgtctgttagcctttttgccaagtcaggccagtctgttttaagggctttttgtaatttgggccctgtatcctttttagaaagaaattgtgaaagattttgaattgggcaaaagagatttgtggatattattgtaatggaatgctggagcctctgggaattacctggtcctatagggctatcttatagggcttacttatctttgaccaggctgtcttacaactctgcaaagatagaagtaaacttctatcttcaaatcattcctatctataaaaatgtaaaattgtctttagtggaatgaaactgattattaccttgtggatattgcctagttttgccagttttgcatccatttgaagttcatttcagtattcttaacctgattataaatgtgtagttctctctcttgctctctctcttttttttttttttttttttttttttttgagacagagtctcgctctgtcacccagtctggagtgcagtggcactatcttggctcactgcaacttccacctctaggttttagtgattcttgtgcctcagcttcccaagtagctgggattacaggtgtacactaccatgcccagctaatttttttatttttaatagagatggggttttgccatattggccagcctggtcttgaactcctggcttcaagtgatccgcctgccttggcctcccaaagggctgggattacaggcgtaagcccctgtgccctgccctctctcgctctctctttttttaagctttttacttttgaatagggttaggtttagatttacggaaaagttgaaagataatagagagttctcatatactccttgcctagtttcccctactgttaacacctcaaattactacggtacatttgtgacaacccaggagccagtattccatactttatttaattccatgctttattcagatttcactggtttttccctaaagtcctttttctggatcccatccaggatgccacgtttttagtggtggcaaatccatacaagtctgcagcaacctcagttcttacctcctcagaagaacaaatttgactgaggggcatagtgagagactgaggcaagttttagagcaggagcgaaagtttattaaaaagttttagggcaggaatgaaaggaagtaaagtacacttggaagagggccaagtgggcaacttgagagagtcaagtgcacggtttgacctttgacttagggttttatatgttggcatacttactgggtcttgtgtctcttctcccctgattctttccttggggtgtgctgtacacatgtgcagtggcctactagctcttggaaggggctgcatgcacagtgtgtttactggagttgtacacgtgctcacccgaggtgttcttcccttaccagtcaaatgttcctagaaggtcatgtaccagttaaactctgccactgtgcctctttagtgcacatgcctgaacccagttgcccaactcctgagatctttttttttttttgagattgagtttcgctcttgtctcctgggttcaagcgattctcccgcagcctcctgagtagctgggactacaggcacgtgctaccatgcctggctaatttttgtatctttagtagagacacggtttcaccatgttggccaggctggtctccaactcctgacctcgaagtgatcctcccgctttggcttcccaaagtgcttggattaccggagtgagccactgtatccagccttgagattttatcaggcagctgctgataaccagtttcaggttttctgtatctattgggagactgcctttccctggcaccggctgcagccaattattattattattaacttattattgttacagtgcaacaactgacacatcacctgatggtggactgacattcctggttggggaggtccctcctctgccctgttcatttctgactggctacctactgtaacaacattacatttagtcatcatgtttctttaggctgtgacagtttcttagactttccttgtttttaatgactttgacaattttgaggagcactggtcaggtgtattgtaaaataaccctctattggaattggatttttttcaatatacatacatactgtatatatatatatatatatatatatatatatatatataacctctataattatacgcagagattatagatctttggaggcagatcacagaggtgaagtgccatttttaacacattatatgaagagtacatgctgtcaactgtcttattgctgatgatgttgaccttgatcacctggctaaggcagtgtttgtgaggtttctcctctataaatttatacctcctctcatactttactcttttgaagcagatcagtaaacgcagctcatactcaaggggtgaggagttaaaatccatctctttatgtagggagtatctatatcgattactaggaattcttaattacaaaagattcgagctggagtgcagtggcacaattttagctcactgcaacctctactcctgggctaaagcgatcctcccacctcagcctccctagtagctagaactacaggtgtgtgccactgcatctggctaatagtttaaaaatattttatagagataaggtttgctatgttacccaggctcatcttgaattcctggcctcaagcaatcctcccacctcagcctcccaaagcactaagattacagatgtgagccactgtgcccagtgtttgagttcttctttgaactgattgttctctatttctggttctctccttattgagttgaatattaatgaaaaaaaattgatacatgttgattttacatttgtatgagagttctgattttaatctcttttaaaatttattttttcatatctttctaccaataaatgttatgggaataattttttacatagttctttgaaatccatagataaatgctataaacaaatgcattccactttgggaggctgaggtgggcggatctttttttttttttttttgagatggagtctcgctctgtcgcccaggctggagtgcagtggcgcgatctcggctcactgcaagctctgcctcctgggttcacaccattctcgtgcctcagcctcccgagtagctgggactacaggtgcccgccaccacgcccggctaattttttgtatttttagtagagacggggtttcactgtgttagccaggatggtctcgatctcctgacctcgtgatccgcctgcctcagcctcccaaagtgctgggattacaagcgtgagccaccgcaccaggcccggtgggtggatcttttgagcccacagattagagaccagccttggtacttcagcttgggtgacagagtcagaccctgtctcaaaacaaaaaaacaaacacaaacacatccttttgaaaagaaataaatattattatagtcaaagaaaaaaatgtgaattattttatcacattgactgtatcagtcaggatcccatcagcaagtaaataacactctaaacaggataacctgcgaaagaaaggtttatttacagagactattgatgaaggtgtgggtggagtagaaccgcagaggttaatgtagtaaccaaggacatagtagcagctgagattttaccatcccttgggcctaaagggagaagtggggcttgggggaatctggaatccagaggtagagatttgcgtagatacttgagaaaaggagtcaaccctctgccaagaagtacagccaactccaactccaggtgaccgttcaggaaggaagctaggagaatgatatggtttggctctgtgtccccacccaaatctcatctcaaattgtaatccctacatgttggacggagggacctagtgacagacgattggatcatgggcgctgattccccaatgctgttctcatgatagtgagtgaattcttatgagatctgatggttttaaaagtggcagtttcccctgtgcactctctctctctcctgccaccttgtgaagaaggtgcttgcttccccttcgccttccaccatgttttaagtttcctgaggccaccccagccatgcagaactgtgagtcaattaaacctctttataaattacccagtctcacgtagtatatttatcacagtgtgaaaacggactaatacagggaataaatatgtggtgtgatgatatatattggttttcatccagggctcctggcttataactcccatagcctttattacagtcctttgttatgatgttggatgtgttaggtctcaggggcaggactctgaccttctccggccctcctttcacctgccccaaggcaggactccagttttctgattgtgggccttaagatcctcccatgagaaggtcccaccctagaccctgggggaagggatgctgacatcatgaagcttccaaaaaaacccgagaggacagagttcagtgaacttctggagacctgaacatgtaggtatagctaaacaataatgaacacatgaaggttcctggtgggtggtgtgcagggcatggaagctctgcaccccttccttcatacctcactcttcacttctcttcttctgtattgttcgcaatagcctttataataaactggtaaatggaagtgtttccctgagttctgtgagccactctagcaaattaattgaacccaaagacagggtcatgggaatcccaacttaaagctggtcagtcagaagttccagaggctcagacttgtgactggtgtgttgggaggggcagtcttggggactgaactgtcaatctgcaagatctgacactatctctgggtatagagcgttgaaactgaattagaggacacccagctagtatctgctgtttggtgtgtggggaaaatatccccacacattggtcacagatatctgtgttgatgattattgtggtgtgagggtagaggtaaaacatggttaaagttttcccttcacaatatacttgactatattttccatcttctttccaatttctgccagggctccccattggcaaaatcaaaccagaaagcatggagacccgttgatatgatccatagagggcatcctctcagaacagagagcaatgtagaaaatgctctggtgtggatctgggggacaagcaagacatatctaatacactgatttaaaaggcctcaaagtctacaatggggactcttatgtcatttttttgttggaagatgatagctaggaatatgaagaaagagatgactacggttaatgtttttgatggaaatctttaatttctcaaagattttagagaagaaatctttaatttctcaaatattttagaaattttttttgagaaagagtctcactcttttgcccaggctggagtgcaatggcacaattacaattcactgcagcctcaacctcccaggcttaagtgatcctcccactttagcctcacaagtagctgggactataggtatgcatgaccatgtccagctaatttttgtattttttgtatggatggggttttgtcatgttgcccaggctggtcgtgaactcctgggttcaagcaatctgccttccttagcctcccaaagtgctgggattacaggtgtgagccactgcccccagccaagaagtgaaatttgacttagtgaatcaaggtccttgacttccccattcccttctttatttcagccattgggaatatggcaagacatcagaagagaatggctgctgggatcctattcttggtgagaatgcccctgacatggcccaacttggcatggcaggaagggatggagccgctgcctttaagggatcatgcagactggaataagaggcatattagtagggaccactaagaacctaagtccttaaggctgtcctgcaattctctggactgtggaggaagggatttggaatcagatttgatttgataaagaaaaataatgaactatttttatgaaaactaaataattgaaagctgtcaaagattatgacagagaagtctatcatggctgactccatcttgtttctagcttcccaggctgcttgtccttgctcattctttggtgtaggccaagctgactatgggaggaatttataatttaattttgaagtaaggatgataataatgtctccttaaaattaactcccttcttgctcagggatcaaaactgccttcgtaaaactaatgaaaggccaagaggttaggattatgggaggggcctgaattctgctaaaatgtaggtatagctaaacaataatcatccattgtcccctagtttgcccttttataatcccttgctgctcaagactcatgtggccagaggttgcaagattttgtgacttccccaattgctcctatagataacatcattatggtagaacctgagattagtcttttgacaggtttttcagacttttgcattctagcaactgactgattccacttggctgggactcatgactcaactggtcccatggctcctacccagaagtggactcagcgcacgaggaccattttctacacctctatgatttcatccccaactaatcagcatcacccattccctaacctcatgcccaccaaattatcctagcgtctgagttcttggggagactgatttggtaataactccagtcctaccacttggctagctctgcattaataaaactctttatttactgcaatactgagttctcagtgaattggttttgtctgtgcagtgggcagggagaagctgttgagcgattacattattgtctttgagtcttataactaagtgaagttaatactgactgcacaataaaataaatgaataatagagattttaataattaattgttcatatacacctatatcttaaatttcatttacttgagatgaacaagggagagcagtattattagatggcagctccctgattgtttgctccttttggcaggtgaagcaaaacaacatgcttgagggacaagatccctcaaatcccacaaataacagaaaaaattccaacttcagaattaattaataactgcattcatgtatttattcaattttaataaatagtcattcatcattccaccctgagctaggtgttagagatagatgagaaataagacactgttcttacagtgagtttagagaaaaaacaaggaaaataaggaataacattagaaaaaactcttatttctctccccaccactgtattttttccctcccttctgcctctcaatcaagaaaggacaggacttagaaggaagccacctcctggaaagcctgaactaaactaaagtggggtgactggccctgactggagggaaggcttgtggcccaaacaatttgacataaaccagattttcaggctcatagaggctccacctctaggcaaatcttttcttttcttcttcttcttcttttttttttttttgaaatagatttgctctgttgcccaggatggagtacagtggtgcaatcttgctcactgcaacatccacctcttgggctcaagtgatcctcccacttcagacccacaagtagctgggactacaggcctgcaccaccatacctggctaatctttgtattttttgtacagatagggtttcaccatgttgcccaggctggtcttcaactccagagctcaaagccatccccctgccccagcctcccaaagtgctaggattagaggcatgaatcactgtattagtccattttcacactgctataaagaatacctgagactgcgtaatttataaagacaagacatttaattgactcacagttcctcatggctggggaggccttaggaaacttataatcatggcagaagacaaaagggaagcaaggcatgtcttacatggtggcaggagacagccagggccggggaaagccaaacattttaaaatcatcagatcttgtgagaactcattcactagcatgagaacagcatgaggaaaccgcccccataatccaatcacctcccaccaggtccctctctctacatgtggggattacaattcaagatgagatttgggtggtgtattagtttattttcatggtgctaataaagacatacccaaaagtggaacaaaaggaggtttagttggacttacagttctacgcagctgggagccagaggcctcagaatcatggcaggaggtgaaaggcacttcttacatggtggcggcaagagtaaaataaggaagaagcaaaagcggaaacccctgataaatccgtcagatcttgtgagacttattcactattacgagaatagcatgggaaagaccagctcccatgattcaattacctccctctggttccctcccacaacacgtgggaattctgggagataaaattcaagttgaaatttgggtggggacacagccaaaccatatcaggtggggacacagacccaaaccatatcagctaccacgccctactagcaaatcttttcttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcaaatcttttcttaaatgccagctgacttgctcttcggaatacctttctgtctcttttctctttcatagcacttctttgtacacatatatactgccttcagagtctccaaaatttgccttgggtttgacttccgactccaattgtttccttcctctaggccacaatcaagagtctgatattctaagtactgtgcttagctgtactctcctataggtgaagccgattaaagtaatttccattaacttgtgaatgaaacttaacattcttaaaaggtgtctttgcattttaatagcagccccttaacacaaattaatctctatttggtaagatgtgtgaaagttactttttgtgggaagaaagagggtgaattattccttaattctctgtttaaaagagttgctactctcagagcctctggagtctcatctcccagtcactccccagcacaaggcaattttgcttttcttcctgaagctaatcactgaaaaattctttaggttaaattcactggacatattttagtcatctctcttaaccaatctgtacaccctacatcttgaaatgttgtgtttcctgacaggagacttagttttccttctctcttttccatatgctccttctgaagttcctgtcatgggatcacctctgtgcttgcctctaaacatcagtgttccagcctcagccttgagtgctcactgtacacactcacctgaggctatgactctactcccatggctttagttactgttcattcgttcatctattcaatactttttttttttttgagatcgagtctcagtctctcacccaggctggagtgcagtggcgcaatgttggctcactgcaacctcctcctcccaggttcaggtgattctcctgcctcagcttcccaagtagcccgccactatgcccggctaatttttttatttattttttatttttagtggagacggggtttcaccgtgttggccaggctggtctcgaactcctgatcttaggtgatagtccattttaatgtctctcaggcatgagaaataaaaatagaattctaagtctccaacctgactgaacagaccccctctcggcaaaggggaccccagagaaaccttgaaaactctcggtcgtgatgggatgggaggtcagacataccttgctgtactccctcccacgctaactgccattaggctttcttcccttaggactaaacagaaactagtcctttcaaaagactccacccttgatttcaaccaaaggcctgaacactgcctctcttgcagtttcaacaaaacaaccaaccagcatttcttccttatgagagatcaccgaccatggagtggtttggccagtctatggagaatgcacagtgagggcttttgtgtcctctgcttcactttttgacatcaggaggcctaaaactccactttcagataacgctaatgccgccatttttggaacatgggtcccataaagaagcatgaagctcaattacacatgcacatatttatcctctcataaatattcaggactccttctatagcttattgaatactgtatatttagctacccttttcagcataaattcctgtcttattcttctaacctttaaagtgcctgtttctggcttctggctggaggttatgcttcaaagcctgtcacaatgatcaccctgcaggctgcaattttttatgagaaataaagttcttctttccaaatttatgagccttgtcattcttcagttgacaggcacctgaaacttagtatgtctgtattagtctgttttcacactgctataaaaacatacctgagactgggtaatttataatggaaagagatttaattagctcactgttggaaggcgagacaggcactttcttcacaaggcagcaggagagagaaaagcatgcaagagcaaggaaaactgccttataaaaccatcagactttgtgagaactcactatcgtgagacgagcatgggggaaaccacccccataatcgaatcatttcccttcctcaacacatggggattacaattcgagatgagatttggatggggacacagagccaaaccatatcaatgtccaagactgaacttctttacctgctccttccttcctctttttctttctttctttctttttcttgctttctttcttgcttttgttctttctttcctttcttctttcctttccttttttctttccctccctcccttcctttcttccttccttcctccttccttcctttctctttctttctttcctttcttctttcttttccttttttctttccctccctccctcccttccttccttccttcctctttcttctttccttcttccttccttcttccttatttctgtaaatggaaaccacgagctgtctccgaatacagaaatgtatgcatttgtcatattctatccatcatcttttgaatggcttttatatttggggaaattcctacattttgagtaaccccttctcactcatgtagaaatcagaacttaaattccccagcctcatttgcagctaggatacaggcatgctgactagatatccttgtgcaagactaaatttggaagtgagcaatgtgaataagcaagctctgcatgagatttctgtcctgttgtcagagctttcaggcacagagtggttcaagacctaatgcagaaatggtatcagcggcagtagcagttttagtaaagccaaattgctgatattttgggctcaacagcagcagcagcaacatttggtatcatttactgaaatacggaacaccagtgacaaattcctgatttgggtagttttgtggcatgttttgggcatggtttctgagagctgctccttgaatgtttctccaactatcctaataattctgtgagttacttaatgtcttttaataaatcagtttttgcttaaatcagccagaatgaaatctactgtttgcaacaaagaacactaattgacagaggaattgtcctcaacttccccttcaaccaacagaatttacagaactcgacttttcttgatccttacttacacttttttagtaggccacatcatctgttacttagattactttggcactgtcctatttggccacccacctctagttttgacctctctactgtagtagacagagcaatctatctttctaaaatgcaaatctcaacctatcactcttaggtttaaggtctttcagtggcttccaaatgccctcaagataaagtctaggatcaagtccaaattccttcttataggctctcaggatctagtcctggttgacttttccagctcatgtttccagcctgcttctcacacttaatgttgcaattatgttttttggcttgtgctggaccagcagcaacaggatcccttgggatcctgttagaaatgcagaatctgggccgggtgcagtggctcacgcctgtaatctcagcactttgggaggccgaggcgggcagatcaggaggtcaggaaatcgagatcatcctgggtgaaagcccgtctctactaaaaatacaaaaaattagctgggcgtggtggcgggtgcctgtagtcccacctactcgggaggctgaggcaggagaatggcgtgagcccaggaggcggagcttgcagtgagccgagatcacgccactgcactccagtctgggtaacatagcaagactcggtctcagaaaaagaaaaaaaaaagacatgcagaatctggcctggagtggtggctcacgcctgtaatcccagcactttgggaggctgaggcaggtgggtcatgaggtctggaattcaagaccagcctggccaagatggtgaaaccccgtctctactaaaaatacaaaaattagccgggtgtggtggcaggcacctgtaatcccagctacctgggaggctgaggcagaaaattgcttgaacctgggaggcggagcttgcagtgagcctagatcacaccactgccctccagcctgggcgacagagcaagactctgtctcaaaaaaaaaaaaaagagaaatgcagaatctgacttactgaagttagatttactccaggtttactgaatcaaatcaacatttaacaagattattaggtgattcatttgcatattgaggtttgggtagtgctgctttatagcaatgtcttctctttccctccagggctcttacacattctgcttcctctctttgaaggaactatcctcctcttctttatatgcctaacactgttctgcaggactcaggcccttatccaggaaaacttttttgactggtgaaggcaggaattaccattttactcctttttctttcctactaaactggagttttctaacctaattgtactttagacttaatctgagaataaaaaatatactggccgggtacggtggatcacaccgtagtcccagcattttgggaggccaatgtgggtggattgcttgaggtcaggagttcgagaccagcctggccaacatgacaaaagcctgtctctactaaaaatacaaaaattagctgggcgtggcagcacacgcctgtaatcccagctactatggaggctgaggcacgagaattgcttgaacccaggaggcagaggttgcagtgagccaagatcatgtcaatgcacctcagcctgggtgacagtgagactgtttcaagaaacaaacaaacaaacaaacaaagatactggttcctgcgtcctgcttctagagattttagttttaattggtttggataaggccttgaaactgacattttaaaaaagtatcccagatgattacaatgtggagccaaattcagaaccactgcactagacttcaagcttctttaggacagggattgtgtcagattcactcttgtttccccagtgcctatcacagtgccaggtacatatactatactggtaaatgattgtttcccctaatttctcagggatatggaatcagatttgtgttgtacacagcattctatcttataccctaacccctctcacacacgttagcatctgagcatccttctcatcaaaacaaagagctacttcttgaggaaagaacttacactggcatttaaaatgcatctctaatcatccttgtattttgttcttaaaccagtttgatactgatatagtgaagctgctttatataatcgagtgctgacaggcacattgttttgaaacagtgtctctttgtaccagttccacagagcaaaaccaccaactctttgtttataaaccttttgagtcctgagaattcaaaatagtgaggaggttgatgagatcaacgcaattataatgagtagatttttaaaaaattaaccagttttctgtgaggttaaaaatgcatttgggaataattttcttaattataccctattttcttacatttaaattgactttaaaaaaactcttaatatcttatatttatacagtgctttacatgttgtaattgtgcaaactcaacttttattaaatatcttttattatcaattgtgtataatattatagaaatgaaatgctatagttgatagaattctttctgtccctgagttgtttacaatttatagaaagatggaacaaaatacttcaaaaagccctgacctaggtctcatgaaaaagacaatttaaagcgtacatagatagctgtaaggaatgacaacatatggcttacaaataccacaaaatccacgctttccagggcatgttccttgtttattattgtagcaggcctgaggaggtagacaaaaggcactctctgtagctgctagatttccaaaatccaaatcttgtttcaaagaatcctatgttgcattcaataattttctttcttaaatcctgcatcataaaactaaaacttcagtgggcttgtcaggacctgggatagtgtggggtggaaaaaagcaccatccatttctcattgcagctgtagtcggagccacagcctggtcatcaattcatatctccctttccgaaaaagaaaaaaaaaactgttcaagcttcaaaaccttgaaatagggtcagcaattaaagttttcatctacccaaagcttttgtcattccaagtaagagagaccaagcccccaattgcccaggggagccctgataccacgtcaattagcaggatttctaggacaccaaactactgttactttctctataaaaagttagtcatgaagattaattttcttctttctgtatctccttgtaattcatatcatacgttttggggatttctgcgtaggctatatgcttgcggtttggaatgctttgtacaaagcatgctggtgtattcagggactgagtgtgggatgtgacccaaatatctccatgttgtatcagttgaactaactagatagttcagttgatttagaattgacaggactacctattgattgacatgtattgattgattgatagaattaactaaatacaaagacaataggtgagtgatattatgtggttctacataacttaggtgcagtcacttagtacacaaagcttgaaacataacctgaaaatcagagaacacaaattaatattgttattgcatttataaaattaagtctatgacaacaggcagattcttgaacattattttagccccaaattttggagatagcttactctataaatattagaaaaagacagttaagatgccttaataattaaaacactaaagtagaagtgtctttatgctttaacatggatgtaacaagatgagtgccttgtggccgggcgcggtggctcatgcctgtaattccagtactttgggaggccaaggtgggcggatcacgaggtcagaagatcaagaccatcctggctaacatggtgaaaccccgtctctactaaaaatacaaaaaaattagccaggtatggtgatgggcgcctgtagtcccagctactcgagaggctgaggcaggagaatggcgtgaacccgggagacggagcttgcagtgagccgagatcatgccactgcactccagcctgggcaacagagcgagactccgtctcaaaaaaaaaaaaaaaaaaaaaagagataagtgccttgtcacttccatgttaagttttattcataccagttaaataatttagatgttactaaataatgagggagctctgtccaaatgtctgtcagaagattctgtgacagaaaattcaaatccttggatactattgatcaatttggcaactgatattcctagcttcaaaaatcaaaagttttagctggacatggtggtgtgtgcctgtagtcccaggtactccagaggctgaggcaagaagattgattcaacctaccagaatgactacactataattaaaaaaaggaaaataacaagtgttggcacagatgtggggaaactaaaacgtttatacattgctggtgggaatgtaacatggtgcaaattgaaaagctttatgatttctcaaaaagttaaacataaaattaccatttgaaccggtaattccactcttaggtatatacctacaataattgaaaacaaggactgacacaaatacttatatacaaatgttaatagtagctttattcacaataatagtagctttattgacaatagtcaaaaggtggaaacaacacaacagatggctggatttaaaaattatgttatatacatacaataaaatataattcagctgtaaaaagagaatgaagttctgatactgcaacaacacagatgaaccttgaaaacattttgctgagtgaagtaagtcagacacaaaagggtaaatactgtataatttcacatatatgaaacatctagaataggcaaattcatagagacagaaagtagactggagattattagggaccagggggaggaggaatagggagttactacttaatgggcacagagtttgtccttggaatgatgaaaaattttggaaatagatggtggtgatggttgtacaatttcgtgaatataattaatgccactgaaatgttcactaaaaatggtgaaaatggtaaatcttatgttacacatatttttccacaataaaaaatgagtcgaaataatcataggtccagcacagtggctcatgcctataaccccaacactttgggaggttgaggcaggcggatcacttggcaccaggagtttgggaccagacgggccaatatgggcaaaatcccatctctactaaaaatataattagctgggcatggctgggtgtggtggctcacgcctgtaatcccagcagttttggaggccgaggtgggcagatcacgaggtcaggagatcgagaccatcctggctaacatggtgaaaccttgtctctacttaaaatacaaaaaattagccaggcgtggtggcaggtgcctgtagtctcagctactcaggtgcccgaggcaggagaatggcttgaatccggaaggtggagcttgcagtaagccgagatcgcaccactgcactctagcctgggtgacagagcgaaactccttctcataaaaaaaataaaataaaaaataaaaaaattagctgggcatggtggtgtacacctgtagtcccagctacttgggaggctgaggcataagaatcacttgaacctgggaggtggagtttgcagtgaacctagattgcacactgaactccagcctggacgacagagtgagactctgcctcaaagaaaagaaaagaaaagaaaagaatcacatttgcagcatgatcttgcaaattgcttgttttcttgcagcccttttattgctcagaaatctaactatagtacagcctagttatctctctaatatagggactatagcatacaaaagcagaaggtatatcctattggtataattgaccaagtgcgtgtttgcttaagaatctagaatttaaatttaggcttctgagtttaggtttgtgtcctttctacagaagaatcttcactaaatgttgactcaaacagagcaagaatggacttcttgaagacctttttgaaattctccccaacaaataagtagagtgtgggagaaaagatagtattgaaagaagtggttagcactgtaagtatcaaagtcaactctaaaagtagtgactggttcgtagtgagaagtaagccctggtgtatatggtagggcatccaacacacaaagaaagagataatggcagtcatcataactttgaagggcttgctggatttaaacaggctcctctctttcaccttgctggctactctttcataacaaaagatgatgatgaagaaaggcagaagaaagcccagcaagaagcggctgatgaaacaggccacatgaatccactgccttgatgcttgcatctccttgctttcccagttagtagacacagcatagttattttggcaagtcacctttcctttacggtcatgatgtgtctctctgaaaatcaaataggggatgctgagggcagcggctgaaatccagactcccaggacaatgctggaagcccagcgcggggttcagtgctgctgggaccacactgggtgaagagtgagaaggtaacgatcaagaccgatggccgaaaggaagaaaacagaggtgaacatccccagagacaaagtgccattgaagaccttgcacaaggcagttccaaagttccagtgattgtcttgaagttgggaggtggccataaatggcagaatcattgttgaaataaaataagagagaatgagatgaaaaaataagagagtattgacagtctgtttcatcttgaatcttagcacccatagatagaggccattggtgatggtaccaattatagatgaaatgtacaaagaaagggcaataatcatttttgatgcaggagctagaaactgagtgctgtttcttactaaagtagaggcattgatcaggtaatcagtagagttgatcagatccataatgacctgtggagtgagaaacagtgaaaataacaacaagaaaaagcaaaagaaaaggttaaatgtaaaaatttaaagagtaattttttacatagtgatacttctagtccaaatgataatattttaacagcagtaagcaaaatatttctgcaaatcaaatatttttctaaggtctatacttttatgttttaatgaggaattaagatcagatgaatctgagcatcaaaaatagaaatatatggatgaaatgaaataaatgtgaaaagaagtaaatgttgggacattttgacaattgttcaataattaggtagttaaaaatctattttttttttctgagataggatctcactctgtcacccaggctggagtgcagtggagtgattacagctcactcagcctcaacctcctgggctcaaggactcctcctgcctcagcctcccaaggagttgggactacaggtgcacactaccaggccggataatttttttgtttgtttgttttgtagagatggggtctcactatgttgcccagcctggtcttgaacttttggactcaagtgattttcccgcttggcctcgcaaagtgttgggatgacaggtgtgaggcactgcgtgtggccaaaaatcttctacttggacgttaaccagaagtctgacactttttgatgggcaaaacttcttgaataaggcaatgtagaatgagtcttatttgacttgtgagggcaaaagtagctaatgaaatgaatttgaataacaaaaataatagcaatgttgcaaattagtagttatgggttttataattagatttctctcatgagctaattatatatagtaaatactattgtctagtattctaatactcagcacataacagtaataactaatattcatatgggagctgtaagccactgcaagattgtgaagtaccttcagaatcatcaacaaaagagggaagtgtattgtaagatgtagtaattttttttttttttgagtcagagtcttgctttgtcacgcaggctggagtgcagtagcatgatcttggcttactgcaaactctgcttcctgggttcaagctattctcctgtctcagcctcctgagtagctgggattacagacacttgccaccacgcccggtgaatttttgtatttttggtagagagagggttttgccatgttggccaggctggtctcaaactcctgacttcaggtaatccatccaccttggcctcctaaagtgctgggattacaggcgtgagccactgcgcctggccaaatgtagtaatattaatagttcattcttgaggaggggacaaaaaggagaaaagtcaccaaactcatatttatccaatatttgtggtatgccaggaactttctataaaaatcatttctggccgggcgcggtggctcatgcctgtaattccagcactttgggaggccgaggtgggcggatcacaaggtcaggagatcgagaccatcctggccaacatggtgaaaccccgtctctaccaaaaatacaaaaattagctgggtgtggtggtgtgtgcttgtagtcccagctactcgggaggctgaggcaggacaatcgcttgaacctgggaggcagaggttgcagtgagccgaaccgagatggtgcccctgcattccagcctggtgacagagcgagactctgtctcaaaaaaaaaaaaaaaaaattctgtttttccttgcaaagcctgtgaagcaaatctttgaacagaggggaaagtgaggcttcgtagggttacatgtcttatccatcaatatttcccaccatgcctccattgtaccaggtgggaaactctactactgttttatattacttctttgaaactcagtaattcatatgtagtgtttttaataatgctcagatgatttagataatcagagtgtttgattatctaaaatatccaatttcttggataatggatcccatggtatcaaaaatataaacctgagaatattttggaaaatagctgttataacagagtcatatcagcaaattggttttagataaattggataaagcaatggaaattactaatgatgcttttttcctcactaaacaaaaacattctaagaatatatacagagaagtaagataattgctatttattttatttttgtttattttttagagacagggtctctctctgtcacccaggctggagtgcagtggcacgatcctagctcactgcagcgtggaactcctgggcttcatcaatcctcccgcctcagcctccagatagctgggatcacaggtgtgcagcaccacatttggctaattttaaaattctttgtagagaaaagggtcttgctgtgatacccaggctggtcttgaactcctggcctaaagtgatcctcccacctcagcctcccaaagtgctaggattagaggcatgagctgccgtgcccagccataattgctattcaaaaatcacaacttcctaagttaattctgccttctaagggagttgcaaaatttttctctaaagtagaaaaatgattcttcatgaaaataccttagtagtcttctttgggaataaaaagtggagtctgaagcatatgaaatggacaggcaatggcaaataaaagaatgagaacttgagagagaggttttgtgaaggccctgggaccttaagaagagggtggaagacgaggatgattttaagacaggcagcacagaaaaaaactcagcaggatgttaggagccctacagaggagaaagggtcaatgaagtattctgagaagcagaaatgacacaggggatttaaaaataggaatgtctaataattataatctatttgctatgctttgatatggtatagtgtcccttttccccattaaccctcagctgtcttgtgttggtggtggttctggggaatcaaagtctctgtggtgtttttatccatggagtatgtgtagaggtgtgtctgtgatcagtgtatgtgtatctcagtgtatttgtgtgatctctgtgtatgtatgtgtctgtggtctttgtatgtttttctgtggaatgtgtgtatgtgtagtgtttgtgtgtttgtgttgtatgcgtgtggtctctttatgtgtgtgcatatgagaaactagatacccgaattatgggaaagatttttttttaattgtgcatctgagctctagaaggacatctgaaagtaatgtagaacatgggcaaaatcatagtaaaacttttctgatcaatgttggtagtgattctgaatatcatataaagtttcctaggaattctgatttattgcacataaccaggagatttcttcatccttaaacacctttaaaatgatgttaaagtacttgagaataaataaatggggcagatctcagactctggcatcccacagacctgggtttgtatcctacctctaccacttaccagctctgcaagttcagataacttgttgagactttttctcctgctaagcccctcagtttttttttttttttttttttttttcagatggagtcttgctctgtcccccaggctggagtgcaatggcgtgatcctggctcactgcaacctccgcctcctgggttcaagtgattctcctgcctcagcctcctcagtagctgggactacaggcacctgccaccatgcctggttaaattttgtatttttagtagagatggggtttcaccatattggccaggctggtcttgaactcctgaccttgtgatctgcccgcctcagcctcccaaagtgctgggattacaggcatgagccaccgtgcccagccacaggcggctttcaggaagaccccacctccacttgggaacactgagctgctggcgcaggggaaggccacaggagcatcgggaagctaatgtgcaataagcctagagggtcaattcggatgatagctctaggataaacctactagtccagagaatcttacctcagacctgtatcttcatgccagattggtcttgagcaggccaaagtgactctacaccatcaatttctcactaggaacagagtgaacaaaatcagtgacactttgccttcatttcatatgtctttcttcttgctgatgctactccccaagcttgaacttgctattatttaaatactcagtgaggtcttttcctctttttggttcctttttttctgtggaatttactgctatagaggtatagagaaatgagtacttcttcaaattatttctccattttgaggggcattaaaaaaaatctgtaagtgaccaagtgcagtggctcacacctgtagtcccagtgctttctgaggccgaggcaggaggacaacttgaagccaggagttagagaccaaaataaaaaaaaaaaatagccgggcctggtggtgcacacctggcacacctgtagcactagctactcaggaggagaggctgaggcaggaggatcacttgagcccgggagttcgaggctgcagtgtgctatgatcatggtggtgaatagccaccacactccagcctgggcaacagagtgagaccctgcctctcaaaagagagagagagagagagaatgaattgcataagctaagtcatttcatttaaaaggttaataaacttgtttcgggtgttaattcccttctcgtattgggtcatcccgccaggcacccactctgcctcaactctagggtgtttattagcagatggatggatggtgttgggtacataaggaggtggtaaatatcaggcagagaccaaaataaactctggaaatgagctatctaatctttctggacagaaaatagttagaaggaaaaacttaaatactgagtttcacattaaaatggaatttatgaggacaggccagagatttatattattcagtttgggttgatgaagactgacaggcagaacaatctgcatttgtatgatggttgtagaacggttggaaaaaaacagaattggttactacatcctagaagatgatctcattataaggaatcttccaacacaggtaatgcatttatgaaccattactgactgagttctacatttcctatgttcttctctctaatctatctctgaaattttttttggatccccttctgtgctgacctcagtgtcctgatttttttcctgcctgctttcctcttcatctcttcattaccagtggagaaaatacatcaaaaccactgtgcagcgttggtggtcaagagtttaggaatcaaaaccattacccagtctttgttagacttagaattttaaaactttaactgctagattgtagccttattaaaaataggcttaaatttcagttcttaattcatttgtggctgtgaccttcaacctaagaactgatctttgcaggttaaggataaattttcaaacctgctactgtgttttaaaagggattttaaaaggaattttgacaggctttcatacccttggggttaattcacagatttggaagcaatctgagatattatttggtccaaacccactaattctgaagattagcaaactgagactcagagaggttaaatgaattacaaaaggttttcaccaagaaaagctaagggctccttcttatgctatcttctcaattaaaaaaaggaatttgggccaggcttttcctcttctcccctcactctctgtttctcaattctataatttctaaaattcataaataacaaatatattagggactagttcttaacttttctcctcaaatatgtactagggctagtacaaccattagatagcctaaaatttgattattatatatctctcctcagaaatacccttaatagtgagtattttcctcccataggtgattaaaccaatgatattaacaatgttaggaaatacacagagtgtatttgaggaagtaattctcttctgtggctttagtaatgtggcttctttcagttcacttttcatatttcaaatcaagtcagatgatttcaaaaaagaacttatggaaatggaaacagttttatgttgttttgatataaccactgtttgaagcagaaatgcagaagcagatggtactgctgaaccaaatgtgtgaaaggctagtaactcatagatgcatataatttttagagttggaagagaccaaggagttaaattcatctaactcccattctataagtatttcagatgactgcagttgtgtaagttatttatgaatatgatttgtctgcttataaatgttgtgcctggatgactgtccttagtatacttgtttatgcttgcaaaaatatgtatgttattattgcctattttattgtgtaaagtggcctataaagtgttctgttgtttttgttactttgttttgttgttgatgctgtttttaagagacaatgtctctctctatcatccaggctggagtgtggtggagtgatcacgactgactgcagtcttgacctcccaggcttaagtgatcttcccacttcagcctccccaagtcactgggactacaggcgtatgccactgcagtgggctatttttttattttttgtagagacgaggtttcactatcttgcccaggctgatattgaactcctgggctcaagtgattctcctgccttggcctcccgaaatgctgggattataggcatgagccacttcacctggccaatatgtttctcaaataaatcttttaaaaatgtaaatgcctttaaagaacttaaaaaattttttttagaattttttttttcagaattttgatcttttaggatttcaacatttgggattgtggcccaaacccctataggtaagggtttagcacagtacctggcacatgatatgtattaaatatatgatagctaatgccaggtggggtgtcagagccttgccacagagagtgatcggcttgaaggtggtaaaaagaatttaccaacaaaagtataggtttgaaaaggaaagttgtattagatggaaagaacactgtggcagagtgcaatgggcgggcgcttcggcaagagaggactgagggagctgcagtggattttccttaggggtatttatggaccttcaagcaggagcttaaggataatttggaccatattagtcacacaggtaatgataaatgattacatttgtagacattttggtgctgtgacatcagtaagaattgcacagtgagttttgacacgcatgcagtctgaagatctatagaaattctagttacttataagtttttgggaaagaagcctggtaccagatgccagctttagataggaaggacatctaattacttctgaattcctcagataaggagttttgcctccagatggtctgcttgctgaccaccaggtgatctttgctctcctcagctaacattaatattatgtaagttgtagtagagaacacctgcaagtccagtgggctggagcaaatctctgagcaatgcaattcaagaaacattcattgagtatctattgcatgtaagacagtatttgagactggggaaaataaagtaagtacttcaaaataattgcccttaatgtttgtagttattaaaggtgatacctgaactcaatagcttagggatgttggggagggcatattctgggtcttggaaacagtatgcttaaaggcaaagctgaagagagcaatgcttcatttttctggcctggttctgtacttttcaaggtcacttctcaccaccctccatattccagcatagtgacagtgacaatgcaggtgtcactccagtgctttctagcctggctgaagtcacactcacctggaaatctttaaaaacatacaaggtgttcctgagatttcattcatgcaatgtttaccaagtatttattgtatttgaagcactattcttgccactggggagagacagtgataagagctgtattcttatggagcttacattctagtggggagaagtgagcattaaaccagtaaatagaggcagatacggtggctcatgcctgtaatcccagcactttgggggctgaggagggtggatcgcctgaggtcaggagttcaagaccagcctggccaacataatgaaaccccatctttactaaaaatacaaaaaaaaaaaaaaaattaactgggtgttgtaatcccagctactcgagaggctgaggcaggagaatcgtttgaacccgtgaggcagaggttgccatgagccgagatcacgccgttgccctccagcctgggcaacaagagtgaaattccatctcaaaaacaaaaaaacaaaacaaaacaaaaacagtaaataaacacagaaagaagagaaacatcagcaagcactacagtgctatgcagaatattaaaacatagaaatgtgagatcatcatggcagatgggagacaggactagattgcagctctaactcggacggacagagcagtgtgtggaggctcacatcatgaattttagctccagaacgactgcaggaacaaagcaggaatcccaagaggacccacagaccctctgaaggaagcagactgctcctgcaggacccaggagacaccccaaatactgtgagtgcccaaactgcagaagtgggaaagggagaccctcctctccagaacacacaaccccactagggaaaatgaacgtctagtttgtgggaagtttcacaccttaccaggagctgaggcaatttagagaggcaagtgaattatgcagcagaggaacaggaaaggtcctgggaacttgctgggtccccaagcaggcctttcctgcctggccccacagggatccttttgggagggcagccagaggtgtgggggagtggggtgggggatgccacagggagaaggaagtctccagctaaactttgtaacaatttgacctgggcaagaagcctcctggccagaactctggcgagggtgtgaatccggcatccagactccacaggtgagggaggaaccaaacccttttcttttgcagctgggaggcgggtagcctggggcaagttctcaagccctgcttgctcactgcctggaaacagactcgtggctgttagggatggcacagtgggaatgagaatggccctttggattgtgtgggacctgggtgaggcctgtgactgccagctttatcccacttccctgacaacctgcatgactcagcagaggcagccataatccttctaggtacacaactccattgacctgggaacctcgcccccatctccacagcagctgcagcaagacccacccaagcacccaaggagagtctgaggtcagacgtgccttgtcctgcccccccccatgggcctttcctaccctccctggtagctgaagacaaagggaatatactcttgggagttctaggaccccactcactgctggttcctcttcatattaccacagctgatgctctctggaaagcaccaccttccagccggagaccaaccagcacaaaaatagaacattgaatgcaaatggcctaaactctccacttaaaagatacagaactacagaatggataagaaagaactcaccaaccatctgctgccttcaggagactcacctaacacataaggacgcacataaacttaagtaaaggggtggaaaaaggcattgcatgcaaatggacaccaaaagcaagcagggctagctattcttatgtcagaaaaaacaaactttaaagcaacatcagttaaaagagacaaagagggacgttatataatggtaaaaggccttgtccaacaggaaaatatcacaatcctaaacatatatgcacctaacaatggagctcccaaatttataaaacaattactaatagacttaagaaatgagataggcagcaatacaataacagtgggggacttcaatactccactaacagcactagacaggttaccaagacagaaagttgacaaggaaacattggatttaaactataccttggaacaaatggacttaacagctatgtacagaacatttcatccaacaactgcagaatacacattccattcaacagtgcatggaactttctccaggataggccatatgataggccataaaacaagactcaataaatttaagaaaattgaaattatagcaagcactctctcagaccacagtggaataaaactgaaaatcaaccagaaataaacttcaaaaccatgcaaatacatggaaattaaataaccggctcctcaatgagcattgggtcaaaaacgaaatcaaaatggaaattaaaaagttctttgaggagccaaatcaagatggccaaatacgaacagctcccatctgcagctcctagcaagaccaacatagaaggcaggtgacttctgtatttccaactgaggtacccagttcatctcattcagactgattaggcaatgggtgcagcccacagagggcaagcaagagcaggtggggcatcgcctcacctgggaagtgcaagaggctggggacctccctctcctagccaagggaagccatgagggactgtgctgtttgacccagatactatgcttctcccacactttttgcaacccccagaccaggagattcccttgtatgcctgcaccatcaggggcctgggtttcaagtacaaaactaggcagctgttttggcagacaccgagctagctgcaggaagttttttttcataccccaatggcgcctggaaccccagcaagacagaactgttcactcttctggaaagggggctgaagccagggagccaagtggtctcactcagcagttcacactcccacagagcccagtaagctaagaaccactggcgtgatatgcttgctgccagcacagcagtctgaagttgaccggggatgatggagcttggtggggggagggacgtccaccatcactgaggcttgggtaggcagttttcccctcacagtgttaaggaaactgccagaagtttggactgtgcagaattcaccacagcgtggcaaagtggctgtggccagactgcctctctaggttccttctccctggggagggcatctctgaaagaaaggcagcagccccagtcaggggcttaaagataaaactcccacctccctgggacagaaggggtggctgtggttgcagcttcagcagactaaaacgttcctgcctgccagctctgaagagagcagtggatcttccagcacagtgctcgaattatgctaagggacagactgcctcctcaagtggctccctgcctcctgtgcctcctgactgggaaacacctcccagcaggagttggcaaacacctcatacaggagagctctggctggcattaggcaggtgcccctctgggaagaagcttccagaggaaggagcaggcagcagtctttgctgttctgcagcctccactggtgatactcaggcaaacagggtctggagtggacctccagcaaactccagcagacctgcagaagaggggcctgactgttagaaggaaaactaacagacagaaagcaataacatcaacatcaacaaaaaggacacccacacaaaaacaccatccaaagaccatcagcatcaaagattaaaggtagataaatccacaaatatgaggaaaacccagcacaaaaatgctgaaaattccataaaccagaatgcttcttctcctccaaatgatagcaactcctctccagcaagggcacaaaatgggacggagaatgagtttgacaaattggcagaagtaggcttcagaaggtgggtaataacaaactcctctgagctaaaagagcatgttctaacccaatgcaaggaaactaagagccttgataaaagattacaagaactgctaactagaaaagccagttttggcagacaccgagctcgctgcaggaagttttttttcataccccaatggcgcctggaaccccagcaagacagaactgttcactcttctggaaagcaggctgaagccagggagccaagtggtctcactcacataaatgaactgatggaactgagaaacacagcaagagaaattcgtgaagcatacacaggtatcaatagccgaactgatcaagcggaagaaaggatatcagagattgaagatcaacttaatgaaataaagcgtgaaaacaagattagagaaaaaagaatgaaaaggaatgaacaaagcctccaggtaatatgggactatgtgaaaagaccaaacctatgattgattagtatacctgaaagtgacggggagaatggaaccaagttggaaaacactcttcaggatattatccaggagaacatccccaacctagcaagacaggccaacattcaaataaaggaaatgcagagaacaccactgagatactccttgagaagagcaaccccaagacacataatcttcagattctccaaggttgaaatgaaggaaaaaatgctaagagcagccagagagaaaggtcaggtcacctacaaagggaagcccatcagactaacagcagatctctctgcagaaaccctacaagccagaagagtgggggccaatattcaacattcttaaagaagagaattttcaacccagaatttcatatccagccaaactaagctttataagcaaaggagaaataaaatcctttacagataagcaaatgctgagggattttgttaccaccaggcctgccttacaagagctcctgaaggaagcactaactatggaaaggaaaaaccagtcccagccactgcaaaaacacaccaaaacataaagaccaatgacactatgaagaaactgcatcaactattgtgcaaaataactagctagcatcatgatgaaaggatcaaattcacatataacaatattaaccttaaatgtagatgggaaaaatgccccaattaaaagacacagactggcaaattggataaagagtcaagacccatcagtgtgctgtattcaggagacccatctcatgtgcaaagacacaacataggctcaaaataaagggatggaggaatatttaccaagcaaatggaaaaaaaaaaaaaagcaggggttgcaatcctagtctctgataaaatagactttaaaccaaaaaagatcaaaaaagacaaagaagggcattacataatgataaaaggatcaatgcaacaagaagagctaactatcctaaatgtatatgcatgcaatacaggagcacccagattcataaagcaagctcttagagacctacaaagagacttcgactcccacacaataatagtgggaaattttaacatcccactgtcagtattagacagatcaatgaggcagaaaattaacaaggatatgcagcacttgaactcagctctggagcaagtggacctaatagatgtctacagaattctccaccccaaaacaacagaatatacattattctcagtgccacatagcacttattctaaaattgaccacataattagaagtaaaacactcctcagcaaatccaaatgaatggaaatcataacaaacagtctctcagaccacagtgcaatcaaattagaactcaggattaagaaactcactcaaaactccacaactacatggaaactgaacaacctgctcctgaatgactactgggtaaataacaaaattaaggcagaaataaataaataatttgaaaccaatgagaacaaagacacaatgtaccagaatctctgggacacagctacagcagtgttaagagggaaatttatagcactaaatgcccacatcagaaagcgggaaagatctaaaattgacaccctcatatcacaattaagagaactagagaagcaagagcaaacaaattcaaaagttagcagaagacaagaaataactaaaatcagagcagaactgaaggaaatagagacacaaaaaacccttaaaaaaatcaatgaatccaggaactggtttttgaaaaggttaacaaaatagatagactgctagccagactattaaagaagaaaagagagaagaatcaaatacacacaataaaaaatgataaagggtatatcaccactgatctcacagaaataaaaactaccatcagagaatactataaacacctctatgcaaataaactagaaaatctaaaagaaatggataaattcctggacacatacaccctcccaagaattaacaaggaagaagttgaatccctgaatagaccaataacaagttctgaaattgaggcagtaattaatagcctaccaaccaaaaaaaagcccaggaccagatggatttacagctgaattctaccagaggtacaaagaggagctggtaccattccttctgaaaccattccaaacaacagaaaaagacggactcctccctaactcatttttatgaggccagatactaaaacctggcagagacataacaacaaaaaaaaatttcaggccaatatccctgatgaacattgacgcgaaaatcctcaatacagtactggcaaaccaaatccagcagcacatcgaaagcttattcatcacaatcaagttggcttcatccctgggatgcagggctggttcaacatatgcaaatcaataaacataatcagtcacataaacagaactaatgataaaaaccacatgattatttcactagatgcagaaaaggccatcaataaaattcaacacccctccttgccaaaaatactcaataaacaaggtattgatggaacgcatctcaaaataataagagctatatatgacaaactcatagccaatatcatactgaaagggcaaaatctggaagcattccctttgaaaactggcccaaggcaaggatgccctctctcaccactcctattcaacatagtattggaagttgtggccagggtaattaggcaagagaaagaaataaagggtattcatacaggaagaggggaagtcaaattgtctctatttgcagatgacatgattgtatatttagataaccccatcatctcagcccaaaaactccttaagcaacttcagcaaagtcttaggatacaaaatcaatgtgcaaaaaccacaagcattcctagacaccaataatagagagccaaatcatgagtgaactcccattcacaattgctacaaagaacataaaatacctaggaatacaacttacaagggacataaaggacctcttcaagtaaaactacaaaccactgctcaaggaaataagagaggatacaaatggaaaaacattccatgttcatggataggaagaatcaatatagtgaaaatggccctactgcccaaagtaatttatagattcaatgctattcccatcaagctaccattgactttcttcacagaattagaaaaaactactttaaatttcatatggaaccaaaaaagagcccacatagccaagacaattctaagcaaaaagaacaaagctggagatactatgctacctgacttcaaactatactacaaggctactgtaaccaaaacagcatggtactggtaccaaaagagatatatagaccaatggaacaggaccaagacctcagaaataacaccatgcatctacaaccatctgatcttcgacaaacctgacaaaaacaagaaatgggaaaaggattccctatttaataaatggtgctggaaaaactggctagacatatgcagaatgaaactgtaccccttccttacaccttatacaaaaattaactcacaatggattaaagccttaaatgtaaaacctaaaaccataaaaactctagaagaaaacctaggcaataccattcaggacataggcaagggcaaagacttcatgactaaaacaccaaaagcaatgtggcaacaaaagccaaaattgacaaatggcatctaattaaactaaagagcttctgcacagcaaaagaaactatcatcagagtgaacagcaacctatggaatgggagagaaattttgcaatgtatccatctgacaaaggtctaacatccagagtctacaaggaacttaaacaaatttacaagaaaaaacaaccccatcaaaaaataggcaaaggatatgaacagacacttctcaacagaagacatttatgtggccaacaaacatatgaaaaaaagctcacatcactggtcattagagaaacgcaaatcaaaaccacaatgggataccatttcatgtcagaatggtgatcattaaaaagtcaggaaacaacagatgctggagaggatgtggcgaaataggaacacttttacactgttggtgggagtgtaaattagttcaaccattgtggaagacagtgtggtgattcctgaaggatctagaaccagaaataccatttgacccagccatcccattactgggtatatacccaaaggattataaatcattctactataaagacacatgcacacatatgtttattacagcactattcacaatagcaaagacttggaactaacccaaatgtccatcaatgatagactggataaagaaaatgtggcacatatatgccatggaatactatagagccataaaaaaggatgagttcatgtcctttgcagggacatggaggaagctgggaaccatcattctcagcaaactaacacaggaacagaaaatcaaacactgcatgttctgactcataagtgggagatgaacaatgagaatacatggacacacggaggggaacatcacatgccggggcctgtcggtgggtgggggagtagtggaaggatagcattaggagaaatacctaatgtagatgacgggttgatgggtgcagcaaaccactatggcacgtgtatacctatgtaacaaacctgcacattctgcacgtgtcccagaacttaaagtatttaaaaaaaaaaaaaaggaaataggaattcagctttgttcaggaggctctttcctgggatctgctcccagcaggtgaccttactggatatgatccaccacattgggctccatatcctctccatgtctggacaggattcccagaactgcaggcaggatatacctggaggagaggcagaaggtgaggctgggaagttggcctagatcttgaaagtacttggattcaggatcagtctcaggagatagggttggactgtggagcacaagaggagaatatcagttttgtgcaggagcaaaagagttaagactttggatagattttcttttttgccaattcagactcgaggtaatctgctgagagtaaacagacacaggatgttggagagcaatgaagatttacaatttcctaggaaagtaatgagatattaaaaatgattgagtggtattaagcctctgtttgagattagggaccaagtggtccctatcctgagaaggcggaaaatacctcatcaggaaaattttaaattctgacctgctcattctgttgcatttgcttctagcctgtatgtaggggcagaaggagatggcaaaatattcagggcagatggcttctaagctaatactaccaagggaggaggccagctgacttgagagtgccagtcagagagtagtaaaagtggtgttgctgggggtttaggtgaaatatggagtgtgcaaagccatcatgagcttgccagatggtgagaaaatgagagcttgagagactggaggtcttagtgcaggcagagtagtagtgtttggataaacatagaaaactatggtcaggtgtgggatgttggaatttaaaaattttgaggtttagcagttctgagtgatggcaaattatctagaatgtggcaaagaaacttgggcagtaaagcagtcattggaattgatatcaagaaacttgaatctgaggttattagatagtcttagtctaagagtggtggaaaatcactgaaaagttgtaagtaagaagtgatacggtcacagcgattgtttaaaaagatagcccagtttttgaggttgaggatggattagtgagaggtgagagtggaagtgggaagaccaattatgttagtttgggttcttcacaagcagaccccaagacaaggattctcagcaagtagcttatttgctaaataaatgattccaggaaatccaataagtggtggggaagagagagggaaaggcaggagcaacaaagggtgaattattaaacagtttacagctgcaggtaactaaagctgaatcccagcaaggaagagaaacaccgggtgtagaacacatactgctggcttacctcacctgcagtgtgaaggcgtgaagggctggggtatatacacatcagctcctgtcagttactgtttgaggaagctcccagtgggtaatttcttggtacttcctctgccacacacatgagcctagtgggatcttgtggccagagaaacttttgggcaaagaaaaaaaaaaggtagattccagcagatgaaggaagtctggccagcaaggactgagatggtaaaggcaaccagtcatgaatgggcatcaaaaaggatgtgttgcatctgtttgaaggctattatgttaatattagtacagacaagggaagaggtagcttggaagacagttgtgaaaggatttaacaggtgcataaatgctacttttgggaacattacttttatattctccattttgttaaccatgcttgtaagagtgctacatttttgttcctcttttaaagtaaagtgcaagcccaagatattccaagtagataggaataaagtctgatactgttactcctgactcaggtgaaaagtgaaggcagtgttgtccaatagaaatactgtgtgagccacatgaaaaattctttagaagctacatgtaaaaagcagatagaattaattttaatagtacatatttttttactgctataatcaaatatatcaaaatattaccatttcagcatgtaatcatacaaaaaatattgatgaggtattttacgtccttcttggtgctaaggctttaaaatctgatgtgtattttacacttagagtatacatcagtttcagtaagtcacactcaagtgcccaatagccaccatagagtgcaggtctaagggatggtttgtttaagagatgtattcttatttcacagtgtattataaatagccgctacctagtagaaggaaaatagtttgcatttaagtattgaatgttaaagctaaaatggaagaagcaatattagtatagttttgactttctaaagaggagtttcctaatcatggtatttactttgacactgccaaatcaagtggaagatataatttgtaagcttagtgtgggtttctcctagtgacaactagatgactagaatgacaactttcttaacaaactgttttgaccttaaataacgagtggccaggtgcagtggctcacacttataatcccagcactttggaaggctgaggcatgaggattgcttgaacctaagagtttgagaccagcctgagcaacatagtgagaccctatctctaaacaaaacaaaccaaaacaagcaaacaaacaaaaaaacaaaattagtaggccgtcttcctgaaaataagcatttcttactgtttgccagttggacaggaagtattctttaagtttttgacatcagaatcagccttttttatggctcacttcacattcatgtctttcaggcagtatcccagtgttatctcttcctttccttatttcaaaacacaattggcagaaggaatgcagagctccttgtcatatgaatcgcatgtccctttctttctccgtcttcatgatggaagtgagaaatttctatggctaggtaagtgaaataacttaagacaatataatacaatggtctttgagattatgatttaattatcaagggtccagagctattcagatgaatgagatcaaatatttaaaaatactcctatacttaacaaaaatttcatcctctaagatatctttatgacagccacggtcaaatgtggctcatttatgtttttctcctaatttgggcatagggacagcataaaaactaaggcaactcaggccgactgtggcttaaccaaggtaaggagtctttatggccatacccaatttaggcataaaatgttcactactggctaccagaatctcatttttatgagacctttaaggagtgtggggtgggtttccttattttataaataaagcattcttctgaggaagtctagtcactgcttcaagattgactaagaaagtaacctagcaaagtacaaaatagctttggagctttggcttcagaaatacttggatttaaatcttggctttactatttttataagatatggcctcagtcctactagattccgtgtttcagatattccctatttatcataaagagatttttaaaaagtgcttgactcactagatattttgctgtggtatataaatctaaatatgtatgtatatttctataaaaatgggccgactctatgtattctgtttggtaaccttttccatttaatatgttttaaatgttttctggcctggcacagtggctcatgcctgtgatcccagcactttgggaagccaaggcggcaggattggttgagcccaggagttcgagaccagcctgggcaatttatcgagaacacatctctacaaaaatttaaaaaattagccagtcatggtggcatgcattggtggtcccagctacttgggaggctaaagtgggatgattgcttgaacccagtaggtcaaggctgcagtgcgctatgattgcatcactgcactccagcctgggcaagaccctgtctcaaaaaaaaaattgttttaaatgttctccatatcagtaaactaatatgttaacaaacacacatctgtattatcttttttttttttttttttttgagacagggttttgttctgtggctcaggctgtagtgcagtggcatgatcatggttcactgcagcctcaacctcctggctcaagtgaacttcccacctcagcctcccgagtagctgggaccataggcatgtgccaccatgcctggctaattctttggtatttttttcatagagatggggtttcgccatgttgcccagtctggcctcaaactcctgagcttaaacaatctgcctacctcagcttcctgaaatgctgggattaaaagcatgagccaccacacccagcctgtattgtcattttaatggttgcctaatattccattgcaagttattctggggattaaagagacaaaacatatgaatataactggcatctagtaattgttaaaactataaagagaaatggtgctgaaattcatatttcatagagtcaacctgctggttgaccttttcacacctatctttgctagccagccattatcttgcatgcaggcagtctcctcctgccttaaagcaagacctccaagacctctgcaggaattgcttcatacatcaggaccaggaatcctgtgtctcagtcactgtaggcaccagaaagaagatggctcagggacctggatagaagatgtaggtcacaaagattttctctcatggcaaataatagaatattgcagctccttagagaaataaaagatatactgccctgtttcaagatctaggccataccaaaggaaagaaaaacttttgagagatggtttttcagaacagagagttaacttctgtctctgtgaagtctttcatttctagcaccctggaggtgtttgttcccttccttttggaataaaactcagctaatgacctctcactttagtgagattatcagaacttgcagaacattccagattcctatttgaaaatatgtgttcctcttactacattcctagccttaaaatatcctctttaacattccaagaattatttttgtagatgatcttggctgcagttcaaaatactgtagtgtttgctaggctagttcatagtccctctctgaataccattttacagaagtgttctcagctagtctgtgatacaggctatctccggagctcagcttgcatgatccctctggtcatatgggacagggtgtaagagaggaatgttgaggtctattagccattcttcctttttactacatctcctgggaagctataggtgccagtgaaaatagagtctgcggggaaggatagctgcatattaggcatcttatgatgctgtcccaggagcttctccaactaagccaattgatgtctcaatttctcaacagaagtagctgtagatagtgaaagaaagagagcatcagtcttatggccaatgaatgctgttgaagtcctgctatgtgccaaatactgtgctgccattgtaaatagaaaaataaaccaggcagtagtgattcagctattgtggagcttcttaattaatagaaaaaccagtaggtatgaggcaaataatgacaactgtgtttagtgatagaaacaaagaggagattgacctagactagggagtcagggagattttcttaaggaagtgactctgagctgagacttgaatttaggtgggtaacaaagatgggggactggtacttccagcaaaggaagcaccttgtgagaaggccccaggtatgtttgagaactgggagaagttcagcacagctaggggcagagagctagggaaaggaatgaggcaagagatgtgcataggaccaaatcatctagagctttatagtcatattaattcctttgcattttattttaagggtgatgggaagggggaagacaacatatgtattaattttttagggctgccaaaatgccatggactggttggcttaaacaacagaaatttattttcccacagttctggaggctggaagtccaatatcaagatgttgcaggcttggtttctttggaggtctctctccttagcttgcagatggcctccctcttactgcctctttatatggtcttttctctgtgtgtgtgagcccctcacgtctctttcttcttcttataaggatttcttcttagaaggacaccgctcagattggattgagatccctccatgatctcattttaacttagtcacctctttaaaggccttgtctctaaatacagtcatattctgagatactgggctttaacatacaaattttatggaaacataattcagccataacaccatacatgtggcagtagtatagagaattaattggagaggggcaattatgcagacccataggagtcttgtgagagatgatagctaccccatcagggtgtgtgccatgaggaaagagcaaaggcagagtttgagaaacatttccatggaggactgatggcatatggcagtgacgtagagggaggagccaaagatgcctcctaaatttttggtttttgcatctggttagtggtgtggtttgtttaaagaacaatggagaaagagaaacaatggttttggggggaagatgatggttttatttctgctgatgttgagtggttgatgagtaggttgtttactggaggagaaatcagcctctgcaacacacagagctgggatcatacggctcagcctctataacagacaaagttgcttgtcgcctagcccttacgttttacttttcatggaaaaaaaacgtgtagcccttttcaaaaacatgctcttgatatccttagaaattcaaaatttgttaaactagggttccaagttaacacttttatagttaacgttgtggaagatttaacattttttcatagtcagcttgacttgtgactattataatgtgcctaaagaaattgcctgttactgggtagggaacaagatgactgaggtacaaggttggaaagacagactacccgttttgaatttttttcttttttcttttttttcttttgagacagagttttgctcttgttgcccaggctggagtacaatggcgtgatcttggctcactgcaacctccacctcctgggttcaagcaattcccctgcctcagcctcctgagtagctgggattacaggcgcctgccaccacgcccggctaatttttgtatttttagtagaaatggggttttaccacgttggtcaggctggtctcgaactcctgacttaaggtgatctgcccaccctggcctcccaaattgcttgggttacaggcatgagccacctcgcccggcttgaatgttttatcaggtgtaagtataacctgatttaaaaaataaatactacaattaaaaaaaattttataatatttattttattctcatgattttaaaatttaaattttcagagcctgtggtcaaacattagccactgataaaatggcaacaggtaacaaatcatataagaatatgttttcattgttcttactcttgatattcttaaatcgatattactcctaactagtttgatttttaaatacatctacctacttgctcaacaccaaaataagagttcaaaaaaaaaaaagaaaaagaaaaagaaattgcctgttatccttaccctgtttgtgaggataaaaccactcttttatttccttttctgcatgctaagtcttagtaaagaatgcgatcttgctctaaaaacgaagtctgtaaaactctgacgtatgtggtaaaaaaggagtctttctatagcagcagagtcccagggagtagagttgtgtgggagttggtggccctctcagtgagagtgagactgtcaatgatagatggggagcagaaaagcagggtcaggaagcagaatgtgctgtagcccaagtgctgggtcatggtcagtggtgttcttgtgtgccctgggatacttggaggcaggctgcagctaggtcagaggtgggtcaggaaagagctgagttatttctggaaaagaccgaagttttccttgagtcccctgccccacgttgcctcaaaggtcaaggaggtgatgctaccttgctaagaagtagctgtaaggcagcctgggtgacaaggcaaaatcctgtctctacaaaagataaaaaaaattacctgggcttggtggtgcacacctctagacccagatacttgagaggctgaggtgggaggttgaggctgcagtgagccgagattacactactgcactgcagcctgggcaacagagtgagactctgtctcaaaaaaaaaaaaaaaaaaaaaaaaagtagccataaggagaggagttagaatgactagctgtcctggtttgtctggatctggggctgaggggttcctggaatatggggcttttggttttaaaactgggtttcgccatgttggccaggctggctcgaactcctgacctcaggtgatccacccacttcggcgtcctaaagtgctgggattacaggcgtgagccactgtgcccggcctgaaatttatttctaattaaacaagttttccataatattttatgagcaagaaaataaaaattgaaagtggaacattacataagagcaaacagccaatgaaaattaaatggagggtggaggggggaagcattgtccaattagggaaacttttttttttctttattttaaaaataaagacacacacctatgaaggaaacatattttttttcctttttttttttgagacagggtctcactctgtcacctaggctgcagtgcagtggctcgatcttggctcattgtaacctctaactcctggatttaagtgattctcatgcctcagcaacatggtgagaccttatctctacaaaaaatgcaaaaattagccgccgtggtggcgtgcatctgtggttcaaactacttgggagactgaggtggggggatcacttgagccccagaggtggaggttgcagtgagcccagaccacgctactgcaacctagcgtgggtgacaaagcaagactgtctcaaaaaaaaaaagtaatgcacacattggaataatatgcaatccttttttaaaaggtagcagattgattgttctgatatgtgaaaatgcccaacacacacttaaatgttttttgttgttgttttagttttttttgaaacggactttcgctatgttgcttaggctggagtgcagtggcacaatctcagctcactgcaaccctcacctcccgggttaaggaattctcctgcctcagcttcccaagtagctgggattacaggtacccgccaccacacccggctaatttttgcatttttagtagagatgggttttcaccatgttggccaggctggtcttgaactcctgacctcaagtgatccacccgcctcagcctttcaaagttctgggattacaggtgtgagccgctgtgcctggcctcaggtgaacattttttaaaaattaaaaatatttagtgatacacgttactaaaatgtctcaggtaatttggtatgaaaatcatattttatttatttttctttttttccagatcccataagactaatgaaaaccacatttttctaaacaggaaattaactatgcagcatgtatttaaacaattattaggataaaatataagtattattcagagaataagtatagagagtatttgtgtgtggtgtctaaagaaattctatcccaaataaatcacttctcagattatgagacataggtttgaatacattcatatttatttacaatctaattgaatgttcatccccacctttcacccacattgaatatcacctttacatagtttttccattttaatgattattattgaccactagggggagaaacaacaaaagctttgaaatttttgatacatttgaaagattatttaaatgccagctgtgacatgtactaattgtagtgaaatatggattcacagaaggtgctagcatatattcttggttgttggagatctgttgattctatggggtccttcagaaataatgtaacagaaaggtgatgtaacttctccaaagggtgaggaacaaggtgttctatggttgaccagctaaattagttttgttcaacttgtgcctttgcccaaagagtaagtgtgaaaaataaacctgtctaattagaatgaatgatgaaaggattaaatgccttggacttcaaagatgggaaaagtggcagtaaaggaaaaatattaacataatcaaaacaatttccctatgctttgccttaagtgcacttgacaattaatacttaaaattatgggccaggtacagtggttcatgcctgtaatcccagtactttgggaggcctaggtgggatgatcacttgaggctgggagttcaagcccagcctgggcacatagtgagacaccatcttaaaaaacaaaattacggttaaacatatagaacatatttgttaaaaagtgactgaaaattctaaccagctaaaggtgtatttatcttaaactactcaatatgtgagtactttgaactctgttgcttagttagaaaatgtttttgaactattttttattcaagaaattgctgactctgttagttatgagaaaaatgtataaaatatgttaattccacaaataaatgtttaaagtctactcaatgctaggtactcaggagacccaaaactggattagacatatatattttcctgaagaagtttgtagactaaaaaatctattcataaaaacctataaaacaaggtagatgtgagacataccattagagaagaggcactttatgtattaagaaggaaaaaattatttctcttctcttctcttctcttctcttctcttctcttctcttctcttctcttctcttctcttctctttcagaaacagggctttgctctgtcgcccaggctggagtgcagtggtgtgatcacagtgcactgcaacctggaactcctggtctcaagcaatcctcttacctcagccttcaaagtagctaggactacaggtgtgtgccacaatgcttggctaattaaaaaaatttttttttgtagagatgaggtcttgctgtgttgctcgggctagtcttgatctcctgcgctcaagcaatcgtcctgcctcagcttcacacggggctgggattacaggcatgagccaccatgcccggcctacttctattttgatgtgtctataggaggtcggggtaggaggtatgaagactgtaggaatcagagaaggttttgtgaagaatgttgcatttgagcagggtttaaagatattaaggatatagaaatgtggcaattacaggaaaaacatttcaagttcagggagcacagtgagcaaaggcatggaggtaaaatgcaaagatgtataaacttcacaccggcattaaacagaggaaagacctggtgatttaaaaagatttaaatctaatccaacatgtgacataaatttagtttcacctgtgactgtttgtgatggttaattttatgtgtctgggccacagggtacccagatatttggtcaaattttttttgggctatttctatggaaagtttttggataagattaacatacacacacacatttatttagagacagagtcccattctgtcgcccaggttggagtgcagaggcgccatcacggctcactccagcctctacatcccgggttcaagccatccttctgcgtagcccccagagtagctgggactacaggcttgcaccaccacaactggctaattttggtattttttgtagagacgggtttttgccatgttgccgaggctggtctcaaactcctgagctcaagtgatccacccgccttagcctcccaaagtgctgggattacaggtatgagccactgaacctggcccaagatcaacatttatttatttatttattttattttttttgagacagagtctcgctcttttgctgaggctggagtgcagcggcgtgatctcagctcactgcaacctctgcctcctgggttcaagcgattctcctgcctcaggctcccaagtagctgggattacaggcgtgtaccaccatgcctggctaatttttgtgtttttagtcgagaggaggtttcaccatgttggccaggctggtcttgaattcctggcctgaagtgatccacccacctgggcctcccaaaatgctgggattacaggcatgagccatggtgcccgacccaagattgacatttaaatctatagactaagtaaagcagattgccttccataatgtgggtgggcctattcagttgaaagcctgaatagaccaaaaaaaacggaccctcctccaagtaaaagagaattctcctgcttgagacctttgaactaggacatgggcttttcctggttctccagcaacgtgctcctgtttggacttaaactgagacatcagctttgcagattttaaatttgccagcctccataatcacttgggtgaattccctgtaataaatctatctattgatctaccaatcgatccatttatctatccattcatgcatcctattgctgctgtttcttaatactgtttaaaagaaagcatctaataatctaccaacaaatatttattaggtgtcattttaatcccagtgctctgctaaacaatggaaaaaatactagagtagcataaatctatagtgaataaatcccagaactacttcaatgaatatatactgataaaactaatttatttaaaatcaatgtttactttattaatttattattaaagaaaacaattaaaactgtaacttggaggaaagtggaaaaataaattataaccccaacagcctaatacaaccactgttagcatctagtgtattttctttcagtaacttttccctttgtggtatttgatgtatataaaatattagtttatgaaaaatcatgctgtcaattcttttctttaacatgatatcacaggtcagatacagtggctcatgcctgtaatcataacactttgggaggctgaggtggaagggatagcttgagcccaggagatggagttcacagtgagccaagatcatgccactgcactccagcctgtccagcctgggtgacagagcgagactctgttccaaaaaacaacaacaacaacaaccaaccaaccaaccaacccaaacattatatcataaacatttccccatttgtttcataatcttaagaattataatttttaatggctgtacaatacatagtctgcaaacatataatttttataatcatttccttatttttggatatttagattatgcagattttttctttttctttttttcttttttttttttgagacagagtttcacccttttcacccaggctggaatgcaatggtgcgaactcggctcactgcaacctctgcctcccacgttcaagtgattcttctgcctcaattcccaagtagctgggattacaggcgcccaccaccacgcccagctaattttcgtattttcagtagagatggggttccaccatattggccaggctggtctcgaactccgtatctcaggtgatacacccacctctgcctcccaaagtgctgggattacaggcatgagccaccacgcccagccgattttttctgtttttaagatcatcaatataaatatctttattacagtcttctcacagtttgaattatttaagaacaaattcctagaactggtattattaaatcaccaggtatgaagtctatatagtaagtctaaattgtttttcacaaatattataccaatttgtaaggccattgactttgaccatacatttgcctacctagtattcattctcaccttcattaatcaaagacttttttttttttaagtgggaatgtgacttgttataaaagcctcatttcctcagactcccttgcatctaggtacgtccatatgaccgagatgtggtctatgatggttacagggttccgctatgagacacacttttgttttattacataaaaggaacatgctctgctggcacacactttttcctcttttccgctcttctttctgactgcaggtagagcagccttcttgcaactttgaggatgaaagctacaagttaaagtggtggaaaaggaagccagaaggagcttgtgactttcttgaacatctgcaccagctctggtctcctttctctggaattcttgttacatgaataaattaatatgtgtttggttaagcaactgtagtcatatttctgctgcatgaaatcaaaggaaaacctaatagtaacatatatgcatagttattctccacaataatgaatattgtcactacaattagtggggatggggcactgagttggtactcttgattgcaaataacaaaaaacctaagctggtttaaagaaaaaagggaattcactggtccatgtactgggggaggtagaggggttgaattcaggcttcacgaagtagcatcagtaacacttttaggtctgacctctttctccctttccctttttcctctctctccctttcacatatctcctttgctttcctctgtgtgttgatctcttctctcctacaaaaaaatggacttcttccacgcaactggagaaattgaccatgttggttgaatgtcaggagaaagaaagaactttacagttttgatcatatcagtccttgggaaggactctgattgaccaggcctgtttcacccattcttggatgtgttcatccaagaagggacggggaatagaacaactgtgattatcatccccaccaggatcactcaaatacagaagaggcaagtcctcaaagagaaagtgaggtgttgacaccataacatagctgctgaaaggctaaaacaacccatcatcaataaccattttttactaataaaatgtttcttattgttattttaatttacctttattttaagttgaagacttttttgtttgttaatttaatttaatttaaaaaatttgaaaattccctctcctaacattgacaaccagaatatgcttatacctgacaaattgggtagttgaatagtctctttattttgaacatgatcccaattttgggcttgtaatctaatattctgtaactggaaatgccatgcacaagggagagaaaatatatgttctttatgatgtctgtgtatgtataatgttctaaaggtcctaaatttagtgcgaacagtggcaatggtgtaagacataaatttaatctgtagttgtatttgagtcatgtaatatatttagtatagagagattaaaaatatagtagattccctttctagaagttaactaaattgattttaatatattactttgtgagggctgggggcagtggctcatgcctgtaatcccaagcactttgggaggccaaaagcgggcagatcacctgaggtcaggagttcgagaccagcctggccaacacagcaaaaccctgtttctactaaaaatacaaaaattagccaggtgtggtggcgggcgcctgtaatcccagctgctcaggaagctgaggcaggagaattacttgaactgggaaggtggaagttgcagtgagttgagatcgtgtcattgcactccagcctgggcgacacaacgagactctgtatcaaaaaaaaaaaaaaaaaagaaagaaagaaagaaagaaagaaagaaagaaagaaagaaagaaagaaatatatactactttgggagaaagtttctttaagtattacactggtatattggcattattgatttttcccaaagactttgaattattcaaaatgagattcaaaatcctatttaggatttaagctttagactaaggcttaaaagtaagacatattgctttttccccccatctaaagtagtctagaggatcttttggtaaataatatgaatattttattaaatattttaaaatttactaaatattcattcatttggtgctcagagccattatttcatatgttgttatggtgcacatgggatcttatgattttggagagcgggacagtggctgttgattctttcattctttacttctagctttggtgtaagggtagttctagggtattgcatgaggcaaatggatgagaaaccaagtcatcattatgcatagctttgcctacatcattccaacaaactgaatttaaatgccctttgaaagtgggaagattgagacctaaaaataagtaaggtattgatcataccatgtaccctatatattaaatcggctagatttcccttttcttttcagaaaaggggcaggtgatggaagtaaatgactatcttttctctgccctcatatcttcttctgtgtctggctgctccagaccagctgccacctgcagttatacaccctgatgtgctactggttgctgagaaagaggcttttaaaaaaaatctcttagagtataaataaaataacaggtcaaaaatgcctgagacatactggtctgctgataaatattaattacacctggatttacataatagacgcttgttcagggtagtttgcaaacttgccatttaggcaactgcattttatatggagcccagaggaaatgacatttaccttccaatggatacttggagtcctaagtaggggctatatgcagctgaaaacatcctgatagccatgtgatttcatgcttctgtaccttgcttatgtttttctcacctgcctggaattctgtattttgttttttgggacttagcatgagtttatattctcttggaagtgctttctgaccattctcatttcgccatgacctaggtgcactttgtttatactctcagagcatcttgtgcataatcatatacttgagttctaatataattgattttcctacctgcctatcccagtgtaatttcagggcgggctgcaaccatgttttatttatctttgaaacattatggcgtaacaaaatactaggatcagtgggtactcagtgtctgttgaaaggaggaagcagttgaattttatctatggagtcttctcatctccctccttgttttccttctcttttgtggtaccccaccctgtcttaccccatctcacgacttttgtgccttcgttcattctccttctggcttgctgatggcttctatttcctgctcttgtctgagcttggaaataagtttatttacatcataaattacaaaccactagagtgagaaaagtgttgatcatccattcaaaagtgttgaatccttcaataattagcagagtacttttcacacataggggttgatatggtttgtctgtgtccccacccaaatctcattttgaattcccacatgatgtgggagggacccagtgggaagtaattgaatcatgggggcaggtctttcccgtgctgttcttgtgatagtgaataagtctcatgagatctgatgactttataaggcagagtttccctgcacaagctctctctttgcctgctgccatccaggtaagttgtcacttgctcctccttgtcttctgccatgattgtgtggcttccctagccttgtggaaccgtaagtctaataaaccctttttcctgtatacattacccagtcttgggtatgtctttatcagcagcatgaaaattaactaatacaggggtttatttagactttaaaatatgttgctttttttttttttttgagatggagtcttgctctgtcactcaggctggagtgcaggggggcaatctctgctcactgcaacctctacctcctgggttcaagcagttctcctgcctcagcctcccaagtagagtagctgggtctacaggcatgtgccaccatgcctggctaatttttgtatttttagtagagatagggttttaccatgttggccagccttgtctcaaactcctgacctcaaatgatctgcctgcctcagccttccaaagtgttgggattacaggcataagccaccatgcctggcaatatctatctagttttctatctagttataaaagtaatacttattcactgtagagaatttttaaaaatacagaatgtcatcaatcataaaaaatcacttatctatcacctatagataaccattaccaatatttcagtacattgatacgtatactcttttgttcccccgcaggcataagccaacatgggtggccaatgtatatacacttttatttatttttctcagcacaaatacaatgatacattgacacatataacagttcttttccatgcatatatactcttttcctttttgcaaaattgggatcatactgtataaaatcttttatcctactttttgtatttaacatgtatcatgagctttttatcattatgtaagcattcttttaaaatgtcatttatgtaatgcgtttcttatttatggatatttagatcatttccagtttttccttttataaaacatgtctgtgataaaaattctgtgcctaaatgatttctttaagataaattcctagaattatttgaccactctgtgtgaatattttaaggtcttttgattcaatagccaaaccaacttccagaaatattatatcacttttccattcatccacccactagcaaatatatatgtattttttttttgagaaaaaaaagcatatatttttttgagatggagtttcactcttgttgcccaggctggagtgcaatggtgagatcttggctcactgcatgcaaccttcatctcctgggttcaagcgattctcctgcctcagcctcctgagtaaccgggattacaggcgccctccaccacacctggttaatttttgtatttttagtagagacggggtttcaccgttttaaccaggctggtcttgaacttctgacctcaggtgatccgcctgcctcagcctcccaaagtgcagggattacaggcataagccaccgaacctggccagcaaatatttttgaatcctttactatgtgtttggctctaggagctaggattataatggataataatacactcaaggtccttgctctcaaaagactgacattctactgaggaagacagacaataaacaaataagtgacaacataaaagaataatagattgttgtcgctgctctgaaggaagccctagtagagtaggactgtactttggttaaagtggtgagagaaggcttttctgacagagttaatttaatccgaaatatgaacactagccatggaagtggagaggatcatctgctgcgaagggcagaatggcaagaaatgaggtcgagagggctatgacgccaaaggtccaaatcatggtcctgtgttaggtgacagggagctattgaatataccaatcatggcaatgtgtttataggcatcaggaggtccacgcttaatcacttttggtgaatgtctgcattttaacagacgtttctagaaataccctccttaactctaaagaatgcccccactggtggaattttgggcatcacagttggtggacatttcactgcctcttaggtcacattttatatggaggtggcctgcatttcctacattcgagggtttcttctcaggctatgtcctcttccatcaatgcccacgagtctacacagatattttggacatatacagcaacaatacaaggatcaaggctcattttcttgccttctcaattaaggttaataaaacctgcttagccatgattttcttggattgattttatatctccttagcagtggaattatttaagatgaatttttaaatatttaatctaaatatgcttgccacatttgcactctgtatttctaatatacatatactatattatatatattataataattatattacttaatattacatattatatggaattatatattatatatagagataatatatgtagagaaatatatacggacaatgaaaataatcttttgtataaagaattaagaagaaattaatttccaaaaactttgtagtattatctgagatacatattgagattcaacagcaggagctgtttctgaatctaaattcttggctttgattagtttgtgtttatattaggagtcaggatctgtattagctttcagatttatttttgagtattttgtgcattgatattttgctgaacacattcagatttatacatatttaaacatgaaaagctttttattttggtagtatagattttacttatttctttcccatcaaaaagaaaatgatcctctattagaattcagattttttcaagaccattctgaaatcaaacatgattatggtgaggaaagcattctttcaattctttgtctaaaaaagcatgtctgtaccgtactattctgattgttcttttgaaaagacatattattataagcaatcaaaacaaaatttgtcttgtataacataaaaggaaatcaacaaatatctactgagtgtctacagtgtaccaggacctgagtagtcactgtgaggacaattgagaagtgcagtatgtgatccctgccctataattgctgacaacctaacaggggagatgaaacacagggatgggggagcccttggacactgacatctatagcgcacctgctgtggcctaggaattgtgctaggtacttccacataacttatctcatgcattgctgagctcaacatcatcccctaaagtcttcagtattctccttcccactctatccagtcatctaggcttcaggtcatccttagtccttgccaccctaacttacctcccacatccaatcaagatgaattttcattcctggatccttccagtggtcctttgactggtctcattgcctctattctcttcccttagcagctcatcctccttccatattgtggacaaagtgaactgtcaaaaataaaaatatgattagattaattacaattcttttggggtgcaaacaacataactcatttaagcaaacgtgagcatttattattatgactgcagcagtgattcttggggtcccaagagtaggttgcagtggggttggatgaacagaatggactgagactgcagtccttcctttctaactcttgtctttgctcttctttaaatgtttactttatttcttactgcagatcaactttttcttacttctggtctatgtggcagaaaatgacagccagactgagcctggacttgatcagtccccattctaaattcctcaggggaaggcgtcatttgacgagcttgggtcaggtgtcacccctggatcaatcgccaatggcaatcaatggcaatcacagttaccttgaaggaaaaaacaactgaaacgttgttattgaaagggagaaggagcagttctcaggaaatgcattgctaggcagacaaatcagtaggcatttcttggagaggctgagcatttgagttgactggagtatgtgattgaattagagggaaaaataaataaggttgcagggatgatagtttggaactaaattttcaagaatctttatgtaaagctaagaatgtgaagttcatagatatttggaagttactgcagtttttaaagagagtaacatgatgaagcactatttaggataatctggaggcaaagtaaatagattagaattgagagacactggagcagagcccatctaggaagaaattacaagagtcagatataagagcactggaaaaacgagtaaaaatattaggaaggacaggattacttggacataggtaggttttttgtcttgttttttgttttgtttttgttttttttgagacagggtcttgacctgttgtccatgctgaaatgcagtggtatgatcatggcttgctgcaaccttaaaatcctgggctcaagtgatcctcttgcctcagcctccccagtaggtgggattacaggcacacaccaccacacccggctaattgtaaaagttttcctttgtagagacagggtcttgctctgttgaccagtctggcttcaaactcctggcctcaagtgattcttctgccttggcctcccgaagtgctcgagtggtgggattacaggtgtgaaccaccacacctggctgacttctgttttttaatctatgtgaaatttttgtgactatcatactgctatgggatacaacacaaaacagaccatatgtttcacagttcataaggctgaaaccatgtagttcaaacaatgctatcatggttgttagaatttctaattttctttcctctgggaaataacagccagggttttttttttttccctgtctcccaccatccccaccccaccgtatcatatattgggaagatattattagaaataggaatgaagccacaaaattctggggactggttaggcagagggcagggagaatgacgaaaccatgaccgattgttttcaattcaagagtggagttcctgtaacaaggataaagctaatatcattaactgtgagtattggtgagtcatttttaaggaagatctgtcaagtttttatagcaatttctgtgtaaagtttattttaacatttatcacattgcattttacttatctctccatgtggccactcagcattgggctgtcagcttctctagggcagacattcttgcttattaatttttatatccatggtgcttggcacaatgcttgacttgttataagtgcccaacaaatgctgaatatcccccatttgattataggcttttgaaggtagggtctatgcttctccatataacttccaaagcatgttgaacaaaaatgctttgaattgaacaaaaattactaatatatgagttcccaacctttcccctgtcttgattcttttggatttttatgctaagaatcaagagcaaaaagagtgtaagagaaaaacaagaaggctacgtttgggtgaagagttttctgggggcttgtatagaagaagtgagggactaccggggatgtgtgaggacagtggatgggacagcatagaaagggattttaagaagtgttgatgtgaactgtgtgctttcttcttggtgttcggacaacacaagtaaaggacttgctttatttttgaactcctgtttgttcttggactgtgtgcctttgatgatgccattctgggatagaactataagggtcacaggtacatgagctttatatttatttagtaaatatctgtgaaaggaaggagaagaaaagagagctaaagagagaagacaatgagggctggatgaaggaagaaagaaatgaagggagtacattaatgtcagatatcatagaggagatatgtgaatctaaaccatatacttccatttccatttagaaaccaatatggttcatctgaattattattaattttctctgaaattggtgagatttccaattagatataaggagctgggtgagtttcaagtgagaataaaaagcactgggacaagctcattttgcattaagaaattcagctgatcttttattacaaataaaatgaacactgaatagtaattttcattaaagaatgaaagcatttaactacttacaaatacttcaattattagttttcaaaatgtattttatagtagagatcaatactttttgtccaaggaaattacccgcttaaaatctagtatttttatatagaaacatcattcctgggataaattaaaaactatttttttctaaataatatacatggatgttgagactaatgtggtatgctatattggaaatatcttcacaaactttaaaatagaacataaaaaatattcaaagggcaaacgaaataaaataaatttcaggaatgaatctgtttttaaggtcatgtataactactattattacataatataattctgaataaataaatcgtgtgtgcatgaacaagctagaagcttattttaagggtttcttgaggctttctcacatttaaaaaagtcaggctattgattatagaatcatagcattttagaacagaaaagggccttggagatggccttgttcaaccctttcattttacaggtgactaaagtatgttatttgggtagcagcaaactaaaaagtcttcaacgatggttctctattgcggtaacaaccactctggcctaactattccttcaccagatcactgcaactcaactgcaggaacacagaaagaacaaaagcgacaacatcaagcctccgggtttgctggaattcattaatgacatcccttcctgctgagctaacaaaaccttgaaccagcaagcagttgtcttcttaaattgagcttgccaactgtgttataatggtggatttagagacactaggtgactccacttgagcagttgtggtggccagagaagaattattcttatcctcatgaaacgtagcccaaacaatcattaccagttggttctagggaactgcttttagtgagactattgttgtcagtattgttgagttggggtaaaaagaaataaggttacagggatgatagtttgaggccaaattttcaagaatcttatgtgatgttaaagattttgaagattgtcctaaagacatttgggagttactgcagtttttttaaaagggagtgatatgataaaacactatttagggtaattcaactggagatgaagtagacagattagaattgggatactctgggaggatagaaggtacaacagaacaagcaggtgtgccccactgaatcatctatacatttagaaaggtaagacatatgtttatctcataaaacaaatgagtgggccgggtgcagtggctcacacctgtaatcccagcactttgggaggcagaggtgggtggatcactggaggttgggagttcgagaccaccctggtcaacatggtgaaaccccgtctctactaaaaatacaaaaattagctgggcatggtggcagactcctgtaatcccagctactcagtaggctgaggcaggagaatcgcttgaacccgggagactggggttgcagtgagcggaaatcatgccactgcactccagcctgggcgccagaatgagacactgtctcaaaaagcaagcaaacaaaaaccaaatgagtgaagatagttctatgagcaaagcagcttttaaatacctgctaaagtgtgatttcccttgtgaattttcttatgtccctgtattagtcagtcctcgcattgctataaagaaatgccagagactgggtaatttataagaaaagacatttaattggctcatggttctgcaggctgtagaggaagcatagtggcatctgcttctggggaggcctcaggaagcttctaatcacagtagaaggcaaagtggagcaggtatgtcacatggtgaaagcaggaacaagggaacaaggtgggagatgctacacacatttaaacaaccacatctcatgagaactcactatcatgaggacagtatcaaggaggatggtgctaaaccattcatgagaaatctgctcctatgatccaatcaccccccaccaggccccactttcaacactggagattacatttcaatatgaaatttggatgggcacacaaaaataagctatatcagccctcttcccgactccaccactgtaattaatcaagcaatattgcaatgattaatttacatgtctctctagtttaccagtaataagctctttgaaggtaggcatagtcttattcctctttgtatatctaccaccccataaatattacatagattgttttgaattgaatatattgttattgtttggtcttgtaggtcctcatcatcaatctctaaatgaagttacttgaagcaattcttgaaaccataataataatgtctccagaattggtggattcttggtctcactgacttcaagaatgaagccacggaccctcgcggtgagtgttacagttcttaaaagcggcgtgtccggagtttgttccttctgatgttcggacatgttcagagtttcttccttctggtgggttcgcggtctcactggcttccggagtgaagctgcagaccttctccctgagtgttacaactcttaaggcggtggcacatctgaagttgttcattcctcctgggggttcgtggtctcgctggcctcaggagtgaagctgcagaccttcaccatgagtgttacaactcataaaggcggggaggacccaaagagtgaagagcagcaagatttattgcaaagagggaaagaacaaagctcccacactgtgaaagaggacccgaatacattcccattgctggctccagcagcctgctttcattcccttatctggccccacccacatcctgctgaatggtccattttacagagagctgattgtctgttttacagagagctgattggtctgttttgacagggtgctgattggtgcatttacaatccctgagctagacacaaaagttctccaagtccccactagattagctagacacagagcactgattggtgcattcacaaaccctgagctagacacagggtgctgattggtgcatttacaaaccttgggctagacacagagtactgattggtgcgtttacaatccctgaggtaaacagaaatgttcgccaagtccccaccagattagccagatacagagtgctgattggtgcattcacaaaccttgagctagacacagagtgctgattggtgtatttacaatcccttagctagacataaaggttctccaagtccccactacactcaggagcccagctggcttcacctagtggatcctgccctggggccacaggcggagctgccggccagtatcggcatgcacccgcactcctcagcccttgggggtttgatgggacggggcgctgcagtgcagatggtggcgcccattggggaggcttgggccgcacaggagcccatggcggggagccggggggaaggctcaggcatggcaggctgcaggtcccaagccctgccccacagggaggcagcaaaggtccagcgagaattcgagtgcaccacgggcgggccggcactgctgggggacccggcgcaccctccaagctgctggcccagttactgagcccttactgccggaggctggcggcgccggccggctgctccgagtgcggggccgccgagcccacgcccacccggagctcgcgctggcccgcaagcaccgcgtgcagccccggttcccgcctgcgcctctcccaccaaacctccacgcaagctgagggagccggctcaggctttggccagcacagaaaggggctcccacagtgcagtggcgggctgaagggctcctgaagcgtgaccagagtgggcgctgacgccgaggaggcgcctagagcgagcgagggctgccagtacactgtcacctctaaataagataaacatttgaagagtgcctttaatgttcaaggaattgtgaaagacacaaagttgaacatgacatggtatctgctttggagaggctcatagctaaagaagtgtattggtttgctagggctgctgtaacaaaataccacagactgggtggcttaaatgaccacacagaaatttatttcctcacagttctggaggctggaagtccaagaccaaggtgctagctggattggtttcttctaagggctctcttcctggcttgcaggtggccaccttctcactgtgtcctcctgtggcctttcctccgtgcatatgcctccccgttatctccttgtatgtccagatttcctcttcttataagaagcagtaagattgaattagggcccaccctaaagggcccaccctagtggcctcattttaacttaatcacttcttcaaaggctctatctccaattgcagtcacatcctgagtttctgggggttagggcttcaacatacgaatttgccggggggacacaattgagcttataaaaggaaggagactataataaacagtttaataccaatcagctttgatgggaggcatctgggaaataaatagttcagaacagtaaactttgcagcagaaactggagatgaaagtttgagactttaatggaatttaataatcaatgcattctcttgaagtcattttacaaaaatcaatataaattttcaaataccttatttggaaagccactgtgtaactgggccagatggtctgacatgaactatactcatttatagtcttttaaggtaaaatgtcctccatgggtatacagtgtagtagtttactggcactgattttggaattacattgttccggtttgagccatggttctgacaggtcctggtctctgtcgtttatcctcaggcaaatggcttattctcactaagtttctttccttgtctgtaaaataggggtaattctagttcctatttcatagggtggttatgaggattacattaacatataggctttgtacatagtaaatggtcaataaattgtagctctgttcacaggctgttagtggcttgaattcctcagacagattctttattaaacataattattctttctgctcacccctgaggcttaacccagtttttcatgcagtattatttatttatttattatttatttatttattatttatttctgttgcccaggctggagtgcagtggggccactgtactcactgcagccttgaattcctgaactaaagggaccctgtcccctcagcctcctgaaatgctgggattacaggcatgagccactgtgcgtggcctccagtgctattttattaatcttaagagatgtatccgtgacagttctaacttgagaaccttagatagagatagtataacataaattcaaagcattactatagattatggtaaattttaatggttctcatgaaaacaataaggatttctttatcaatctgagagaaattctgttgggaaggtattatagcattaaccactctgtactgtactgtgtatatgtttgcctccttggttagactgtgaattcttagagaaaagaaaacatgccatgtttatctttgcactgtgatgcaacgatggtgtagtggttaagagcatggtctttggagccagccttcttaggttgataccctggtctatatccagacttttgggattcatactttacttgtttgtgtgtccttgggcaagatacttaaccacttgagaactcactcacctgtgaagtagaaatagtaatgatgtctacatacttcataaaaacttctatgaggactaaatgaactagtatatgtaaagcttaaaatagtacttggtatgtagcaagcattcagtagattttcaccatcattagtatagcacatagcttagctgtgcttaataaacatgtgttaagtgaatgaataacacggattctgagtagtaagaagttggtggctcagtgctagctggcattctatagctaagcatgcaaccaaaatcgtataatgaaggaccactgtcagggaacagtggcttatgataataatgtgctagcaaaacctggaggtaagtttcctgtaactttgtagaatgtgtgctaatgctgatgagtccaacactgtgccacacattttccagcaaataatgaatactttttgagggggaaaaatccctgggaaaataaaatagcttcaggaagccatgaaactcttgctttatttttgacttggcatagaaggtggggcacataccttgttctgaaccgaagaaagtgtagtgaaaatattatttcatatttctcttttgtctttggtatagcagagtcttctggtgcccatacaatactccttctctctttttccttgccaacagtcgtgattttatatccacccctcaccttcctgttacagataaatcctgatttgtctaagtcaattgtggacacagacacaactccaaacacacacacacacacgtgcatgtgcatgagtgcacgcgagtctgatttaggaaggagcataagacacaattctggccaaagaaaaatgaggataaatctgtgatgagggcttctggaaaagattttcttactcttaaaaagagacacgcaggaggaggcaacctcattttctgctgcacattgccacgtcaggatgaaacgtttggaattgtgacagcatcttgtaagtatgagggggagctagctatcaaaatgtaaacaaattttctctttagaatcagtgagatttaatctacgacagaaatttaagcttaggtgtgaaatgactttctctatgtctcctatgaagtttgtggttatctcattattacattctagatttctacactttccatctagtgcattcaaatatgttgacaatttttagagttacaactatgtactgttgcttactttatatctgtgatttttgatccttgtttccagaaacatcttcaatcttatttttttataacagttttgtcaaaatctaattcacatactatgcaattcgtcaatttaaactgtacagctcaatggtttttagtatattcacagaattaagcattcctcaccacaatcgcggttagaatattttcatcaccccccaaagaaactttgtaaccgttagcagtccttccgcatttatacccactccctctagtcttaggcagccactaatttactttctgtctctatagatttacttattctggacatttcatttaaatggaatcctgtatggtcttttatgactggcttctttcacttggcatatgaaagattcatccatgttgcagtatgtatcagtatagcatgtcttctcttgctgaataatattatattgtatggatatgccatattttatttatccatttaaacagctgatggacatttgagttgtttccattttttggctattatgaataatgctgccactgatgtacttgtaccttttttttttttttttttttttgagacagagtctctctctgtcaccaggctggagtgcagtggcgcaatcttggctgactgcaacctccgcctcctgggttcaagtgaattctcctgcctcagcctcctgagtagcttggactaccggtgcatgctaccactcccagctaatttttgtactttttactagagacggggtttcaccatgttggccaggatggtctccatctcttgacctcgtgatccgccctcctcggcctcccaaagtgctgggattacaggcgtaaaccaccgtgcccagccacttgtatatatttatgtacacattttttgtgtggctatatgttttcatttctcttgagtgtataccaggagtgaagttgctgggtcacatactaactctatgtttaaccttttgagaaactgtcagatattctttaaagtggctgcaccattttgtatttccatcagcagaatataagggaaccatttctctacgttccctccaatactcatcatctttcttttggattatagccaccttagtggtatctcaacatagttttgatttgcatttctctgatggctaatgatgttgagcatgtttaatgtgcttattggccatttgtgtatcttctttggaaaactttctattcatatttttttaattaataaactttatttttagagcagtttatttaggtttatcgaaaacatgagcagaaagtacagaattcccctatattcccttaccactcccccagtccacacacagtttcctctattattattttttgagacggaattttgctcttgttgcccaggctggagtgcaatggcgcgatcttggcttaccacaacctccgcctcccaggttcaagcgattctcctgcctcagcccccctagtagctgggattacaggcatgttccactacgcctgactaattttgtgtttttagtagagatggggtttctccatgttggtcaagctggtctcgaactctcgacctcaggtgatccgcccaccttggcctcccaaagtgttgggattacaggcatgagccaccgtgcccagccagtttcctctattattaacatcttgaattagtctgatacatttgttataattgatgagccaatgttggcacattattattattacctaaaatccatagtttacattagggttcactctacattgtacattctgagggttttggcaaagttataatgacatgcagtcaccactacagtatcatacagagtcgtttcactgccccaaatatcccctgtgttccacgtatccatccttcccacttcccctttcccccaaaaccctggcagccattaatctttttactgtctccatagttttgccaatttcagaatgtcatgaagttggaattgtatggtatatagtcttttctaattggcttctttcacttaaatatggattgatggttcctcaatgtctttttatgacttgatagttcatttctctttattgttgaataatactttatcgtatggatgtaccacagtttatttatcctttcatctattggatggcattgtggttgcttttgagttttggcaaatatgaataagtggctgtaaacatttgtgggcggggttttgtgtataaatatattttcaattcatttgggtaaatgaatgcagtttctggattatatggtaagagtgtgtttagttttgtaagaaactgccaaactgtcttccagagtggcaatactattttgtattctcaccagtaatgaatgagagttctttttgctccttttgtctattttttaaattgggttatctgtctttttattactgacttgtaagagttctttatatattctagatataagtccctcattgggtgcatgatttgcagaatttctccccatcctgtgggttgtctttattttcttgttggtgtcctttgaagcacaaattaaaatttttataaagtccagtttatgtcttttttcttttgttactagttctcttagtgtcttgtctaaaaagcctttgcctaacccaaggtcatgattcattcctatgaatgattcttcaaagagttttatagttttagctgttttatccatttaaaattaacttttatatgtgatgtaagttcggagtccagctacactttttgtatagggataatcctgctgtcccagcaccatttgttggaaagagtactctttcccccattgaattggcacttttattgaaattaactggccataaaaatgaaggctgattcttgggcactcaattctgttttagtgatctgcatttgtatcctcatgccagtactacactgtcttgattaccgtagctgtgaaggaaaatttgaaaacagaaagtgtgagtcctccaactttgttcttttcttcgagattgttttgtctattctgggtcccttgtattttcatatgaattttaggattggcttatttttttcttttcttttctttctcttttttttttttttttttttttttgagacagactcttgctctgtcacccaggctggactgctatggtacaatctcagctcactgcaacctctgccttacaggttcaagcgattctcctgagtcagcctcctgagtagctgggattacaggcgtgcatcagcatgcccggctaatttttgtatttttagtagagatggggtttcaccatgatggccagactggtctcgaactcctgacctcagatgatctgcccactttgtcctcccaaagtgctgggattacaggtgtgagccactgcacctggccggtggaattgtttccttaatttcatttttgaattgtttattgctagtgtacagaaatacagttgatttgtgtatatagatcttatatgctgcaaccatgctgaactggtttattatttctaatagttttagtagattcattctgtttttctacatatgagataatattatctggaaatagaggtaattttactttttcctttccaatctagattatttttatttcattttcttgcctacttgacctggctagaacctccagtacaatgttaaatggaagtggcaagagtggattttttttttttttttttagatgagggtctagctccgtcacctaggctgtagtgcagtggcatgatctcggctcaccacagccttgaccaccagggctcaagcaatcctcccacctcagcctcctgagtagctgggaccacaggtgtgcaccaccatgccagactaattttttgtatttttgtagaaacagggttttgccgtgttgcccagtctggtcttgaactcctgggctcaagtgatctgcctgccttggcctcccaaagtgctgggattacaagcatgagccaccgcgcccagcctgagagtggacatttttgtcttgctcctgatcttagggaaatagttttcagtcttttactattaagtatgatgttagctgtggttttttttttttaaatagatgccctttatcaggagtgtctaaggagaagagagacagcaacaagcaatggaaaaatagatgttgatgggtatctcatagaaggttctgtgccctaccttttgatcaaagccccaaggacaggtaaaaacctgtgactgtctaaggcattcaaaaacagagccagattgtgccgtgctccatacaggtaaaatcagagttcaaaatagaaactgggctgggtgcagtggttcacacctgtaatcccagcactttgggaggccaaggtgggaagattgcttgagcccaggagtttaagaccagcctgggcaacacagagagaccctgcctgtacaaaaaatttaaaaaaaaatccaggcatggtggtgtgtacctgtggtctcagctacctgggaggctaaggtgggaggatcgcttgagcccaggaggtccaggctgcagtgagctgtattcacaccactgcactccagcctgtgtgacagagcaggaacctgtctcaaaaaacaaacaataaaaaaaaatgaatttaagttgtaggaaaataaagttacattttttgctcacacaaattgtaagctgaaactcataatcactgtgttattaatcaccaaataacttttacatcgggttttttttcactcataagtggtaatggatatgtataataataatttccagtaacataatctttctggatgcctgtcctgctcagtatgaatcaattctgtttcttagtgaatacgtttttaaaatgctaaaacattttttggaattagcattgattttttaagggaatctcctgtggctagagcagcgtatctttaattgatttggagttagagaataatacatttatagaaaagacaatcacattttacataaaaatcaatgccattttgccatgtaaaggcttctgggaagctgactgaagatgtgaatcttgaggcattcccttttatacgttcaaatgaaacatttattcattactttcttattttgtaggactgttatgtaatcagaagcaggatttcatgcaaagtgtggacatacattatgattttcctaattaccacactgcattttaatagaaaaaaacccatcaaaattattgaatttagccctggaattcaaaacaaaaactatttaaaataatatttttcctacgttttcaaaaattttcccattttgagaagcctacattatcatatttctttgagcgcttactttacttctttttcttcttgaaaacttagaaaagcattgatactgggtattgttttttactttataaccagtggttctcaatcctggctatacattagagtcaagtgggttgcttttatttatttatttacattgttttagtttttatttatttatttacattgttttgttttttatttacatgattgttttttagagacaggttcttgctctatcacccaggctggagtgcagtggtacaatcatagctcactgcaacctcaaattcctgggctcaagtgatcctcctgcctcagcttcctcagtagctgggactacaggcatgtgccgtcactgggttgcttttaaaaaataacaacacgcgggccttaggcacccctgggggtgagagtttgtcactgatattctttaaaagctccccagtaattttagcatacagctaggttgagactgttatttaaatgatcactagaaatggtgaattttatggtatgtaaattatacctcaataaaactgtgtaaaacaataatcaccaacaggtatctaaagcctcactgacataaagtgtctcacccatatgactatcaggtgccaacaggcccagtttccccaggatcgagaggtttccccacacgagggacttgcagtgctataaaactgggaaaatcctgggaaaactggaagaggtggtcacactgtagtatggaagagatggcttttctagatagaaaagaacatttttcccttcttggtaaaggttatttgaggagaaacagaggtggttctagcttcttgcccttctcaaagacactcattgtagccacttcttgacctcatactcactcatgaacaccttgtcctttgacttcaaactccaccacctcactgaaattaccctcttggagatgaccaatgactttgtaatcaccaaatccagtgactcatcagtgtcttctgctgatgcctttaccccttccttcttgctttctgtggcatagtattagagtgtttttcctactctccttgaaccattgctattgcctttgttagctctgttttttttttgttgtctaggtgtaggcatttttcatggttctgttgtcggctcttttcttgcctatatatacttatgatttcacctgtttcctttctgcatagattcctattgtcagtagctgttttcatgaccaggacagcctttccctctcagtatctatggccctaatggggtaatagaagagagaaagacacacacctgcttgcacaatcttagaaaactttattgtcttcatagtgagtcctgacattatagggggcagatatgtaacgtgacacatcaagacaaatttatagtagttaactttgacaaaggttcatatttcctgcctcagtaaattgcaaaccccatgaaaaactctgtattgtctccctagcatttggcaaagtgcctggtacatagtaggcactaaataaggagctgtgcatcttcaatagcaacacatttgctgttgtttctcagttcagcctttcttacaccattctcagtcacatgccaaaattagtagagggagatgggaaaggcctgattgccgatgaaggggtatggcctgagggttctcttaagttctctcggtattttgtgacatatagtatttacctaggagccctggaaaagtttccggatggatctagatactttaaagataaagctattcccatcccaatttccattaaacctcaagtttccataaatgataacaacactgtgtaactgtatcccagttccaaaataaccacacaatattctaagtaaagaggaaagcagggaaatagtctgtagggagcctagaagaaagggagtcaaaggggaagactcggacatcatgtctcttctgtttagaacgttggtggacagatcatagcagatgctttactgcaccttggcaaatgtctctctatgggtctaatgagctgcgtgaggctaagctagccaatggagattgttcacctaattctatctctgattttgtgatcagcaagcaggagtcagattatgttgtagcaaccaacatggacttttctacaggtacgaactaagcaatgtgagctctagagttgagttgacaattatgtttctcactttaaagtttgactttacgttagtctgtagctgtagcatgcattagttgtcccaaggccagtcatctctggatgcactgacaaaatggaatttttcatttgacctgcaaaactggaagaatatagtggctacatcaaggagacaacactgtgaaacagcaagctgacccgagacaacgtgtctggctttccttttctacctctgaaattcctatttcatatctctagctctaacttctcttgagttccagtcatctgggcatctccacctttgtatcccaggcccatctcaaactcatttttttttttggtgtcagggtctcactcggtcacccaggctggagtgcagtggtgcaatcatgcttcactgcagtctccacctcccaggttctagtgatccttccatctcagcttcctgagtagctgagatcatatttttattttttgtagagatggggtttccctgtgttgcccaggttggtctcaaactgagaccagcgatcctcctgagctcaagtgatcctcccacctcggcctcccaaagtgttgggattacaggtgtgagccacctcagctggcctcaaactcattcctaagtgcaaattactaacctcaaacttccaatcctgtattgtacctgctttggatttcttcagaggacttctagcttgcatagcacttacttgttttatacattgtttgtttccctccaccacaatataaggtccatgagacaagagtttgtgtatgttttgttcattgctgtattcccactaccaacaatagtgcctaatatgcagtgggtattcgatggatatttgttgggtgaatggagtcctttcagtcttgttttcaaatatcttttaggttaatgttgtcctttcccttcttattgacaccattacgttagactatgaaatagaatctaccaagtctcatataatctaggtttctgttactttaatcctgtgcatcattgccagatcaatcctacttggaaattatctctcattgtgtcactcccttagttgtagctcaatactgtttaaatataggatcttcagccaggcatttggagctaccacaatatgaccccaatctgtcacttcaattttctttcgtgtgattcctttacagatgccttatagtacaaccaaattgggctgcttgttctttgagtatttcttgaactttactacctctgtacttctcccattcagttactttgctcaggaatgcccatttccagctgtttctgttggtatttgcttttgtgtagctaataatattcatagatgactattttaaaatttatccatttaaaaaattgacattgtggtcagatgaggatttagctcttttatactatcacacttcacctctgtgccacacagcttctgtttttccctccggttcctctgtcctatatgggccacatcaacagcttctgtgcctctggctccttgctgggtttggacagtggcatgttcaagggagggaggtgaggcaggtgacggaggtgagggtgtttattaccccaactctcttccactgtccctcaaacgaaggttattgttccattcaatacggcctccttttcacagacttcttttggattttggtcagctccctccctctttctttggacctaggggacccaaccctgggttattaaatatccctgtgatttccttacatgctgcccacatttttggagatgacatttttataaagaaacgcctctggttaatcctaatctgaatgcaccctctgctttctgttgggatttggctgacagatgtattctctctgcatcctcccaatttagttatattaaaatttttgttacaccaatattattattgttattttttttttgagacagaatctctgtcacccaggctggagtgcagtggggtgatctcagctcactgcagcctctgcctcctgggttcaagagattctcctgcctcagcctcccaagtaggtgggactacaagtgtgcatcaccgcacctggctaatttttgttttttttgtagagatgggatttcaccatgttggccaggctggtcttgaactcctgagcttcagtgatccacccaccccggcctctcaaagtgctgggattacaggcgtgagccaccacacctggccaaaatcaatattatttataataatatgacattataaatatcatagtgttcccccagcaaatttcctttctgatacagccttttgttttttcacaaatcggttattatcttatttgctcatttgcttagtttatgtggagctttttttttttttttttttttttttttttgagatagatctcctctgtcacccaggctggaggacagtggcgtgatctcagctcactgcaacctccgcctctccagttcaagcgattctgcttctcagcctcccgagtagctgggactataggcgcatgccaccatgcctggctaatttttgtttttttgtagagacgggatttcaccatgttggccaggctggtcttgaactcctgagctccagtgatcagcctgccctggcctcctgaagtgttgggattacaggcgtgagccaccatgcccagcctatgtgtaacttttgccgcttcttcctagaaagacagttgaacagattagacattctatttcttctggaaatttccctcctgagtcttaccgtctttttttttttttttttttttttttttcaatcatgcttaggaatagtctaggcttgcattcaatatctctggaatcctaagactttttcttggtttactcctttgatttactgaaaaatatataacagtagtttcctaagaagtgagaggcaaattctttgaggtcttgactctcgaaaaagttcttgataatttggttgggtacagaatactgtgttgaaaatggcttttccctcaggattttaaaagcattgctttattatcttttattatcttgtgtttttgatgagaagtgcaataccattctaattttctaactttttttttttttcaagacagaatcttgctttgtcacccaggctggagtgcagtggcgtgatctcggctcactgcaacctccacctcctaggttcaagcagttctcctgcctcagcctcccaagtagctgggattacaggtgcccaccaccacacttggctaatttttgtatttttaagtagagacggggtttcaccatgttgatcaggctggtctcgaactcctgacctcatgatctgcccacctcagcctcccaaaatgctgggattacaggcgtgagccacctcacccagctttcctaacttttgaatgtgattttaagaagtgtttagaagatgaatctttgtgttagtcgtttgatttttttcactgtgattgacctgtgatacatcctttcactctggatatctgtgtccttaagttcttatcattttttttcttgcaatattatagaatacgttcttagctgcctgctcaacagacattctcttcatattctttgctaacagaatcccgtttttatccgggcaacaatgcgtccagacctacaggatagatacatcatgattgttaaaacaaatcatggtaatcccctttccgtttgccagatgcagcatttactgttccagcttaccttgtaactaagggtggctatgtgatacctttcttctggtcaatacgataaaggaagtattctcgggggaggagaggcttcagggaatggttttattttccaatataagccacaagcataggaagagcttattgtgttaccacttttctcttctttggatttgactgtgagagagcatattgtcaccttaaaattgtaatagccatcttacagtcaagtggggacaagcctaaggcaaaatgccaaaatactgagactgtcagagttgattgagtcagtacatcaaaccaggcacagttcctccagacttcatgttatctgagataatggaacactttcattattttagccagtttttgcgggtattttgtcaggggcaggcaaatgacttctgattggagcatagtcctttgataagtttttctcttcattttccctgtctgtttctggaacttctattagctggagcccctggattcatttctttaccttttcccctcttccttttccccatcccctttctcactgttctaatttcctgggaaatttcctcaattttagccccaaccattctactaaattattgatttaagccatcaggtttttaatctcataaatgtaacattttttaagaattagaggctagtaattattgttttgaaaagttttcttctgctacctgcattgtctttatttcttctgaattccttttctacactgttgtctttagggtaaaggtattcctcaactgttgggtgatactaggctgtctttttatatttgcaaatggttcttaaaagttgattgggagctttatgtatatggatggacttccttatatgtgatgaggcagcaagcaagcttttttgtttttgagaccccaaaatagcagtttctatagatcttttaggattttaaatttcttcaaagaaaatcatcaaaggaatatacagatacatgcaagcattctaggagtagcgtaggtgaaagtgattataggccccacagtttactacctagactttcacttaatccttctgtgatgtactgctaaatattaacaactagttatgtgaaagggggaaaaaaagacctgatttgtagcatttgccaacatctgtgtgtcattattctcaacatggccaatttcagcctaccaacatgatgtcatttaatgtggagttgggaagatacacatagtagcttgccatcatcacatagtatttctaccatacgaacacaataggcgtaaataacctcgaggaaatagtaaaatatagtaaaaataattaggcagttataagctttgaatattgattatgtctgtttttaatacaatttatttaattgtaagcttatataatttaagttttttcaatggcactgtttaacaactggcttgccaaattcctgaaaatttagcaatcagttcttgtgagctggtacaaactagttccagagcatcactgctgtttccagtcctaggcccaaccctcaccatttactgtgtctggccttcctgattctggagcctctattgctgattttctcctgagaatatagttctggtagcctgcaaggtgtggtggtgaaggataaaggataaagagttatggcctaaatgtatgggttgtgactgagtaaaactaggaatctatagcttattctacaggcttttgacaaatccctatattttcagccacctacctaagcacttgccttcgacagtgcctagcaccacagattcctgagccctctttgtctctgccagtaaaagaagcttctctgcagacaccaaagagcagtgcctctgccttcctgggtcaggtgctgctgttctacctgcttcctctcttctaagatgttgacatcacttcttggttattatcttttctcccattctctttgtccttgtggatttatgccttttatatgtcctttctacattttagtggcagcagataaataagtgtattcagttaggtttgtttaactggaagaatagctcaataagtattgcatttaaaatttgttgaattgacttaagattcctggagttgttgtagcagcaactaaactctgtcaattgttgctgctgtcagttagcaggaactctgtcaattagcaggaactcaccaactactgatttatttagtgtattattgtatcctaggctattagatacccactttgatttttcctctattctttccttaaaatgaactttttattttagagtagttttagatttacagaaaagttacaaagactgtacagaatgttctcatatacccttacccaattttccctattataagtatcttagtatgttacatttgtcacaattaatgaaccaatactgatacattactattaattaaggtccatactttattcaggtctccctaatttttacataatgtcctttttctgctccaggatcctcttcaggataccacattacatttaatcagcatatctccttaggcaagtcttggctgtgacagttttcagattttccttgtttttgatgactttgacaattttggagagtacagattaggtatattatagaatgtccctcaacttggatttgtttttctcatcattagactgaagttatgggtttttgggaggaggaccacagaagttaaatgtcattttaaatatatcgtattaagggtctgcaatacttaatgcaattctgatgctaaccacttggagtagcacagactccaagttaaggtcacaatccccagcaagactgctctcacttcagatgctagccatacgtttgggggttcccaggccacccacacttctgcccaactaactacacattcaggggttcccacaagcccttcagctttgataattccctagaatgactcacggaactcagggaagatctatacttacgattataaagcacacaaatcagggacagccaagtgaagaaacacatagcaagaggccagggagagcctcaaacacaaactttcatgtcctctccccatggagtcagaatgtgtcacgctcctggcacatcaatgtgttcacaactggaaagctcttctgagctgtggtgtctggagttttgaattagaatttcattacacaggcatgattgattgaattattagccacatttttgaactcagtgtctgggacccctcccctccatggagttgattgagctgtgttgatatcacctggctcaaaatctccaagtctctaatcacatgattggtctttctggcatgccagctcccatcctgaactatcttattagcataaattctatgatctgaggggctcatgaataaccgtcactcttattacttgggaaattccaagtacttggcatcttcctcccaggaaccaaggatgaatgaaggccggtcaaattctttactatacagcatactatcaacatgacatatcactgatgatggtgaccttgatcaccaggctgaggtagtgtttgtcaggtttctccactgtaaagttattctctcccctcaccttttccgtactctactctttggaaggaagtcactacaggcacttcagatataaaaagttatgcccaacctccttgaggggtaaatatttacattaaattaatcggaatactttgacaagagagatttatatcttcctcctgtttatctatttattaatgatttactttatatcagtgtgggttcatgaatattttatactttggttataatctaatagagctttattttactactcacgttgttctagccttggttgttgggaagtcttgcagaggcatcttgtgttcctttgacttcctcccgccactgtgaattgttttgtttttgtttgtttttagcacttcctttcttgtactacaagatgctctaagctcatcttctgtttcctgccccagtcctagagccagccatttctctagagagcactggttttttgaaattggagaatacgttttatctacattctttttaatcattttcttttctttctgacttttgtttaaactttatttttggaaataatatagctagtcagtgctcattctcattttgggtgagattactgagatacagaaactgtaaatcagggtctgtctttcctcttgcacaggagacaaaaacagcattttaagtaaaaattgcagttgcaaagacccggagtgttttctttttgataacccccataatcccagaagggatggaattgtctaaaatgaaaaagagaagcacagttcagggagttgttggatgagactacggaaacagcaagagaaaacatgattttgacttcatgatttttgtctagaattttattttggagatttaacactggaatttcatctctgggaggcctgggatatctattttcttaccaacattttatgttatgaagaatttaaacatttaacaaagatgaaataattttagcctgaaataattttatggtgaactctgttgatatcacctagattttatcattaactgtttatactccttgttctatcacatatctgtttatccctctgtccatctattaatcttcttatttttgatatattttaattgcagacatcagtatacttcccccaatacttcagcatttgtgtcaatagctagagttcaatatttacttacagtttttaaaatgtaaaatttatatacaatgaaatgtgcaaagtgtccatccatcaacagatgaatatataaagaaaatgtggtatatatacacaataggatattattcagccataaacataaataaaatatagtcatttgcaacaacatgaatagaagtggagccatgttggccaggctggtctcaaactcttgacctcaggtgatccgcctgcctcagcctcccaaagtgctgagattacaggcatgagccactgtgcccagccttaattgccttttatttatgaaaataccacaagtttaaaatccattattttattgactgggcattttcctacttgagactactacgaaaaaagctgttatgaccatttccgattaagtcttgttggctatatgttttcatttctcttcggtaaatgcttagcagtgcaattgctaggtcatagaacaggtgtatatttaagcctcataatgccagaccactttccaaaatggttgcaccacttaaaatttcctctaacaaagtgtatgaaagttccgatttcctcacaaccttgtcagtgtttggttttgtcagttctttaaatatttgagattctggtgattatgtagtgatacatcattgtagttttaatttgtatttccctgttgactaatgatactgagcactttttcatgtgctcatggctattcatgtagcttcacttttatgaagcatcttttcaaaccttttgtctatttttcaattcaatttttttttgtgtgtgagttctggtatttctttatattttagatcagtgctgtccaatagaatttcctacatttgttcaaaatgttcattgtaaaatgtgtctagtgtaattgagaaaaaaactgtatttaattttgatcaatttacgttgatatagctacattgactgatgactaccatatcaaatagtgtagttctagatatgagtcatttttggatacatgttttgtgaatattttctcccagtctgtggcttggctattcattttctttttttaaaaaaattaaaaacaaaatttttaagttttatggaagtatggtagttgtatatatttatggggtacatgtgagattttgatataagcatataatgtgtaatgatcaaatcagggtaactgggataaccatcacctcaaccatttattttttttttttttttggggttaggaagattccaatcccactcttctatttatttttaaatatacaatgaattattattaactgtagtcaccctatgttgctactgaacactagagcttattccttctatctaactgatttttgtacctattaaccagctcatatttatcgcccttccacactgcctttcccagcctctgataaccatcaatgtattctctatcttcatgagatcaagtttttcacatatgcgtgagaacacatgatatttgtctttctatgcctggcttatttcacttaacgtaatatcctccagttctattcatgtcgttgcaagtgacaagatttcattcttttttatggctgaattatatcctattgtgtatatataccacattttctttatccattcatctgttgatggatggacacttaagttgattccatattttggctattgtgaatactgctgcaataaacatgagagtgcagatatctctttgatatgttgactctctttctggttatatacccagcagtggaattgctggatcaaatggtgtttctagttttttattgttttgtttttttttttgagacggagtctccctctgttgcccaggctggagttcagtggcgtgaacttggctcactataacctccgcctcccgggttcaggtgagtctcctgcctcagcctcccaagtagctgggactacaggcacctgccaccacgcccagctaatttttgtatttttagtagagacggggtttcaccattttgcccaggctggtcttgaactcctaaccttgtgatctgcctgcctcggcctcccaaagtgctgggattacaggtgtgagccaccgcacttggccagttttagttttttgaagaagttccatattttccatagtggctgtactaatttatattcccaccaacagtgtagaagggttcccctttctccacatcttcaccagcatctgttattgcctgtctttttgacaaaagccattttaactggggtgagatgatatctcattacggctttgatttgatctgataattagtgatgttgaacatttttaaaaaacctgaatatctgtatatatttatttgtacatcttcttttgagaaatgtctattcagatctttttctcacttaaaaatcagacttttttttttctgcttttgaggtgtttgagcttcttatgtattctggttattaatcccttgtcagatgggtagttttcaaatattttctcccattctgtgagtggtctcttcactttgtttccttagctgtgtagaagctttttagcttgatatgatctcatttgcccacttttgctttgtttgcctatacttttgagttcttactcaagaaatctttgcctgaaccaatgtcctggagcatctcctcaatgttttcttctagtagtttcaagtttcagctcttagatttaggtttttattttgatttgacttttgtgtatggtgagagataggggtctagtttcattctttctcacatggacatctagtttccccagcaccatttattgaagagactgttcttttcctaatgtatgttcttggtccctttattgaaaatgtgttgactgtaaatgcatgaatttatttctgggttctctattctgttccattggtgtatgtgtctgtttttatgccagtaccatgttgttttggttactatagctttgtagtatgatttgaagtcaggtggctttgtaatataatttgatgcctctagctttgttctttttgcttatgattgctttggctattctggttcctttgtggttccatataaattttaggattgttttttctatttctgtgaagaatgttattggtattttgatagggtttgcattgaatctgtagattgctttgggtattatggacattttaacaatattgatttttccaatccatgaacatggagtatctttttcctttatttttttcattagtgttttacagttttcattttagagatctgtattagtccattctcacactgctataaagaaatatctgagactgggtaatttataaagaaaagaggtttaattggctcatggttctgcaggctatataggaagtgtggctggggaggcctcaggaaacttacaatcattgtggaaagtggtcattgtagaatgtgaaggggaagtagacacatcttcacatggccaaagcaggaggaagactgagatgggggagttgccacacacttttaaaaaaccagatttcataagaactctatcagtagaacagcaccaaaggaggaaatctgcctgcatgatccaatcacctcccatcaggccccacctccaacattgggtattacaactcaacgtgagatttgggtggatacacaaatccaaaccatatcaacttcttctctttctccttctccttcttcctctcttcctctcctccttctcctccttctcttcctcctcctgctcctcctcttcctcctcctccttctccttcttctccctcttttttttttttgacggtctcacttccattgcccaggctggcatacaggggtgcaatcttggctcactgtagcctcaacttcctggactcagatgatcttcccacctcaacctcctgagtagctgggactacaggtgcacaccaccatggctggctaattttttgtatttcagtagaggggattttgccatgttgcccaggctggtctcaaactcctgggctcaagtgatccacctgcctcaccctcaaaaattgtgagctgttgtgcccagctgagatctttcacttatttggttaagtttattcctaggtgttctattttatttgtggctattgcaaattggctattcattttcttagtgggatcttttgatgtgcagaagttttaaattttgatcgtgcctaacttgtacattttttaaaatggcttttgtattctgtgacacatctaagaaacttttgatcactcctaagtcaggagtaaatgctctcattttgcactttctcaagaaattttagaatcatctcattaattgctgggattatgattggggttttgttgaatctatagatagcgtgcaagtaacattgactttgatatttttaatttgagactttcaggaatggatatctatgttggtcgatgtattttaatactttggcgaaaggaaaacagggtctgatcagccttctgtgttttaggcaagaagagagcctataatagtctacaaaatacttctattttgtgttgtttactcagaaggactttggacaacaatttctttgactgaaactggggtcagagttgcagactccctggaacatgaaaagtcaataatctagttcccaaaaggcagacaagaaactattcccaagatgaacaaatgatgagaatagaggtaaaggtgaaaatgatggtaagtgtgaaaaatccatttataacacttcaatttgtgttctttaaggaagaaaatataccttgtgctttttctggtctgcagcatctctaaactatttgcctttattttctcaaaagtattttaggaacagtgaagttacacaactttgttctcttcagttcttattttaattcaatatgagcttggaagaagaatctacagattatttcatttaatcccttcatggtgtatgaagtaaacagatttagagttaaatgatttgtctgaggccatgcggctagttagtagcagagttctgacaacatcccaggcttttctatctctctactccactgatatttccagtatgcattgcttttataatagctaaccactcactaactcctgatcccctacaatgtgcctggcgctgtgctacatataggtgatataaattatcattataatatacttttgttcctcaaataccacatagctctatgtaatagaagacatatgaaaatagtaaaaggggccaggtacggtggctcacgcctataatcccagcactttgggaggccaaggcgggcagatcacctgaggtcaggagtttgagaacagcctggacaacatggtgaaaccccgtctctactaaaaatacaaaaattagctaggtgtggtggcaagtgcctgtaatcccagctactcaggaggctgaggcaggacaatcgcttgagccggggaggcagaggttgcagtgagccgatatcatgccactgcactccagcaggggtgacagagcaagactctgaccccaaaaaaaaaaaaaaaaaaaaaaaaagaaaaaagaaaagattgtatgagagagacctgacataggctagcattgctaacttcaatttataaaatgaaagcaatcaaactgcaccttaaattcatgttctattaaataaaatgttaactgttaaggaaggtgaagtttaatgcttgatgaaattatcagagaagtctatagaaaaagaaaaatttgagacagaatttcaaggaatgatggaattaggaagggtagagggattataaactattataatcgggacacaacaaatatgttaataaaaacttgaataccttataaattaaaatgcaatttcaatgcagttcaagacaaggacattacatatgtttatgggcttctgaaataaattacttttaactaaaactaatgaaacacagatttatatgagaagcttagaggtaaattaagtcgtgaagtaggcattcagatttctttctgcagaagtagtgatatttcccccaggcgcttctcttatggtagctggtcctaagggaatactcttttgtcagtagcatgcagtagtcctgtataggtaataagagacctccatctccatattgctttcagcaatttgccctaaaacaaataatctaaactctttgattcctcatttccatatgcagtaataggactaataataactgccctgtcaatctcatggcagttgtgaaaatgaatatatacaatttttatttatcaattatattacacctcaataaaactggagaaaatgagaaatgtacagattatggttcaatgaagattctatgaagatatttttagggacaaaatctgcagtgttgtctgcagcattgacttggttgtctccaaagattataatagcattaataatatttttccttgggtttagataactctatggtgtctgtgcagtatgattaattgaatgcttcatatgtactgaatcttttttcatgaactaggctgatttacaatgatacagttagcagttatttagggtgtcactggaaaattcttgtttatattactttttatttatacattatgtacaaaaaattgccttcttcatgcttgtatccatattatttacataattgaagaatgatgatgaactgctaatgtagacagagaatggagatgaaactaatttcttatataaccactgaagagaagagtggtcatggagagaagagtagaacaagaattataatcatgtttaatttttctttcacttggaaatgacttgagtgggttcaaccattactaagaaaaatataatttgatttgtgaaacaaagagattctaagaatctctttgtttcacaaatgtctctattctctagtatctaatattaaaatattattttatggggttggcaattaatattataaaatgaatgaattattaatagttaataacatttaataactctcaacaaagattcaaactacacaaaggttttaattttgtaacaaaatgtgcaattttttccacaaatggcaaaaaagaattgctcacaagaaactataccttgactgtagacttattaaaatctaggttattgagtattagttatctattgctgcataaaaattgcacaaacttggtggtttaagacaatatgcatttattatcacacggtatctgtgggtcaggaatctgggcacaacttgagtcctttgcttcataatctctcacaagactgcacggaagaatctgcttccaatctcacatggttgctggcagaattcagtttcttgcaggctgttggactgagggcatcagctttctgttggctattggctgtcctttgctacatgggcttttccacagggcatttcacaagatgatagcttgctttctcagagccagttgagggtctcctagcaagacagatataccatgttgtgtaatataatcatagaagtgatatctatcagttttgttgcattttattgattagaagcaagttctaggtcctgctcactctcgggagggacttacacaagggtgagaataccaagaggtgaggaccactgggggccatcttagagtctgtggaaaaagaatggattaatttgacatatggtagagtgaaaagagagggtaaactcagatgcttattagcaattcatatccaattaattctataatccagaagcaattggtgggaatggcttaatagaatttccagttagcgatatagtatcacaaactaataagcacaaggtgctaagtacattattttcttcttctgtgatcctgctctgtctccagtgctgtcagctgtgaaatgagaaagccttccatcagaccctggaaaagatgtaaagagctgtacttcagaaaaatattggagaaaagtacaaatcttaaaaaaatttttttgagtagtgcatttcatcagcagatgctgtcaattttgttatactggtaacagatatctatggaaaatgaaattctcaacagcacattgccagcatgttcccccacaaaaacagccatggttaaataaaatagaaattcttgcacatgattagaaatttgcaaaagagattaaatgtggcattgatataataaagcctttgattaactaacaaaacttcatcaggtatctaaaagagctgtttgaatttctaaccaagtcagaacaccagctattacactccttaaaacaattatgccccaaattaacatcttatatgcaaaaacattttgtctgttttgaagactaacaaagactggaaaagcatgagaaagatgagtagttatcacttcaatagtgtttggattattgagttatggttaattgatggtctttaataggatttacaaagctagtatcatagacggtcagggaaatcctctttccaaacattatatagttaagtcacagaagatgctgtggaaaatagacccaaatagtgcctataagtatagttggtatgaattgaagcactacaagcagtgatagagctgtgtggaagacagaagacaaacatcacacttttaagtttgccgatctaccctggaataaattgatgttacaatccttgatgtttgtatttctgctctgttgctctaagtgagaatataggatgtactttgagagattacagtaagttgtaggagttcctcactcatataaatggattgaacagggccaggtgcggtggctcatgcctgtaaccctggcactttgggaggatgaggtgggaggattgcctgagctcaggagttcaaggccagcctaggaaacatgggaagaccctgtctctatgaatgaatgaataataaacagatttaatgaattctggatctgctgtatttatcgcatatcatgtataatatctttatgtatggttaataaattctaaatagaaaaggttaataaatgaatcaacaagattgggtaccagaacaccaagtagataagatattatccaagccacacgattatagagaacatcctcacattttggcagcagcataaaacagacaaacatctacattatctcatttttcctgaagaaaacagaacttcacatgagctgaaatgaatgcttggtatcatgatgggtctctgtcattgtccttggtatgtcctctaaagtaaaaacaggaaaatcctcttctgaatacctaatgaagtaaggtttcagcaaagtcttgtagaaacttatgttctctagtctctaagaattgaaaggtgggaggggcttggctaaaggaatacttgtttggtactggagaaaatgaaaaagcaaaaacatgggaattctggggttccgtgcctcgcaaatatttgtcttgggtgacaaatttttttccaaattctgattgtgtggctcctgtttcaggatgggctctttgaagctttaaacattaatcagagactatattcaggtataaagcaagcctgtgacctttgtccaaggattcagttcagtcttgtaaatcagaaattcaaatgtcaaatcattcatgatttattcagctttggatatgggcatttagaaacacatgctgtcaaagtatagaggtgtatttttagtcatttgaggcatattctctgaagtctatcccatctacaaagatacatacatttcctttatgtaattttaaattataagaatggggaacgtctttgacaggactagtttatgccagttaagatgctgaaaggccagcaaagtctttgataggggaaaggccatgaatttctagatcacatttcatattgagagagtggctcattgtgggagctattcacttaaacagatttattctatatttcaatgtgcaaattagtattcaatgtagctaagagacagtttcatgcttggagccatgaacagggaggtttgaaaacaaatcacagtgtgaggcaaagtagggtcaattaagggggttgccatttagacaagtcccatagatgggataaggttttctttttggtgagcctttggacaggatgagaaggtcagttgtggacagtaacctcaaactaaaggaactgaaataagtttctgagctttattcagtatattcaacagagacaaactgtccaagataccctattcttccttagtgagttgagcaagggagtggatcacacgttctcagctgacattgacacagcctgaggcctatggaaagggaatgaggtagtcttcttatctgtgagggaatctgaaacttcagtgagtccttagtcacctaagaagggttgtcttttgggaggaacgagggcaaccttacaggtataaatccttcctttttagaaaacaatacaaggtattactctacacataattaggagatattcaaaagaatcttctttattttgatcagtatttatttatttatttataaatttctgtcagggtgggggaaaatcttgttcaatacagattccaccaggattgtagctaagtcacagacagcctatgcagtgtccagatatccacatgctgaggtgaacttcatcttcaaggtatttatctatgcataccagcatccatggagatgctaataactaaccatgcagattgttgccaaatgttccctaattcttgaccttaaggactctttaggatcagcattctcttagccactttgtggctcactcagatctatctatctgcctaaacataacactcaaccattcttattctgtggttctgccactgcactgagctccacctggtaatggggacattgattctgttgttttcacatcccccaagctgatttggggttctgttgtcccccctccccactagagattaatcttgggtgaacaggagagaggtagtctcagagtatgggagtccttcttattcgctgtaacaggcacagattattgtagctcaaataacagaaatcctagccaacagtggcttaaatatctcacataaccagaggtctggaaatgcagaccaggactggtatagcagcttagttatactgccaagaattcatcttcttgccatatttcctctttgtcttcctcagcttttggcttctattattgtggttgtcattattgtgcttttcatgttcacaagatgactgccacatctccatgtcacatccatggtcaaggtgggaaaaaggagttagcaccaactacgttccactcaatcagaaaagcaaaagctttctcagaaacttcccagaaaaatttccctttaccacattgggttagccaattacaaatgactggtacaagaacccatggatatttaagttctcagttttcttcagattctcttcatccctcataatcccaggaaacttgttatagtctgtctaggacagatactaacttggctcattgactacccacttccagtcacattctccattgctttcctctactctacaggttagagagctctaaatgcttaatttctcagtttctcttggttctaaggatggtcatgtgacccggttctagccagtcgggtgtgtgtgtgtgtgtgtgtgtgtgtcttcctttcctgaataaaaaaggcaaaggctcactaggaaattctctttgtcattccctcctcttcctatatggaacatagctttgatgcctgaaggtacaacaaacatctcatgactatgaggggatgaaaatggataccaaggataccaagatgatggaacaaaaagaattgatttggaacatgacggcactatggattcatcgtattggacctctgtgatataattctgaacttttcatataagactaatatacccctacttgtttaatacaactgtagagttatctgctacttgcagccaaatgtaatcctaactaatataggcaataaatcatgtttttatatcactatgtaggtcttccaatctattgtctttgccagagctgtctccattcttctaaaaggtcccaacttccaaaattcaaaaccaagaaaacaacctcttttctctgacatttttattgggtcagacattttgctgtgtcagaaaatgattccatataatttgtccaaatggggaagggctatgcgagatacaaggaattatagggagaaaattattgacacatatttaaaaatatatctcagcatagttacaaatacacagaaacccatccaaattagactaagacagtaaatttattgggtggatgtaagtatatcttatggacctaaggataggaagtccggttgaacctcattatgaactggaaccaggaactgaaaagttatgaaccagtgcagctcttctccctttcctctatggtaacatgatctcttatgatctactttcttcttctctcttgcattggctttatctgcttctgcatgcacatagtagaaaatagtaatttcaactgtattagctcaaagacaaactaagattgactaacacctgttacttttattttccaggctctctggagaattaatctgattggtcaattttttggttgtacatcagtctttagtccaattagtgaccttgggaatggggtcaaatgacttagcaattcttaggaccaaaggagaatacccttttgaaaagaggccatggatatgtatatgtgtgtcagtgttttttggagaagaaacatctctactactctcctaaaattttaatttggggaaaggtaaaccaaagtaatgattcagccattctacaaacattattctcacttgctcctcctcttatgttttctctcagggaattcatctagttgctcatgtcataaacctctacacaaccaatgattaccacaatagctaacaattactaactctgtgacagctgttctacatgcattatcttaagttcaacctcacaacaaccatagaagtaggaattaactattttattgataacaaagtgaaatttagagatgttaagtcaagccttcaagagagagacctcatgtctccttgtctctgatcttgccccgctgatccatttcttttttaacccagtaatcatagtggtatttctaaaacacaaatctgatgttactttcctgcttaaaatccttctatagttcccttaggataaagtccaaatttctttacaagatatatacagcctttcttgatttaggcaacctccatctaaccaaccttcactccatcctcatctcttttagtcactttgtcctaagttgcacagatcatttacagttcttaacaatccagaaaagaaatgtattttctactcctcttgtgttctctcttcttttctctcttctttctttttttatttttatttttgatatcttttttatttttttatttttattttttagtatttattgatcattcttgggtatttctcggagcgggggatttggcagggtcataggacaatagtggagggaaggtcagcagataaacatgtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaataatttttcttagtacagaacaaaatggagtctcctatgtctacttctttctacacagacacagtaacaatctgatctctctttcctttccccacatttcccccttttctattcgacaaaaccgccatcgtcatcatggcccgttctcaatgagctgttgggtacacctcctagacagggtggcggctgggcagaggggcccctcacttcccagacggggtggccgggcagaggtgactccacctcccggacggggtggcggccgggcggggtctgccccccacctccctccgggacggggcggctgaccggatgggggctgccccccacgtccctcccggacggggcagctggccgggcgggggcttttctctcttctttcatctttcttccttctactctcttcttctttcttcttccttcttctttcttctccttttaatttcctcttcctccttcctccttccttctttcttcttcttctgacaaggtgtcactctgctgcccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaa

SEQ ID NO: 1061 - DNA, 1353 bp, Homo sapiens
acacttcctttactccttaaagttaaccattttcacactaacttaaggccttttgttccaaatatccttgatactgtgctgtaacaactgagcacactcttaacctcctatcagttgactgtgtgcctttcttttaaaaattaggtctgtgtttcattttcagtgtttttgtctccctcctctctctcagggtctactatatgctgttatctctgtgccactgtaacctgctgtatgaccacataagtcaagcttctgtgacaattttttaaaaataagcataaacagctctgaggaaaggcctaacagtctaagaacaaagaccatagtcccctcggagggacctgatgacatacattttatggcttatttccagatcatggctctgcttgagaggtaggcaaagtccattaataagtgtccttgggatcagtgagaaaaatctccatcagcatttccaggtgcactagaaagttttgtgggtacttaccaaccaacagtgatagatccctgaaggggccagtttttccagttccaattgtgataccaaataaatatcatgtttaaggtcagcaaagtgaggtagaagtagggttactgctctaatgcagtgctctaaagtaagacctcaactttcctttttgttcattttaacagcacagccctttggcagggagcttcatgctccctggaatcctagtggggatgagaaacacaagagctcctttccctgtggaagcctctggattctgacacagcttcacctcttccccacagcctcacctctctaagccagtttcatgactataaaatgaggataatgaagtacctactgcccaccccagagcactttgtgccaaccaaacatgaaagagaacgtaaaagtgtgctgtgcactaacaggactccaggagatcagcattatcacagctcaaaggcaagcctggccaccaggcatccatggcaatctcatgccaggcaggaagttcctatgaagaaaaacaaagacacgaataccccttagctggaaggagagaaggtaagagcctccaagtgagaatggagtgatagtctgtgcttcctggacagaggaagtcgcaagaggaacggaaagcaggttttgaacagggagaaagcaaaagacctcagataagcaaagatgaggaagggacatgaggtccaaacgttgaataaagaaacagtaatactgggcactgtgggacgcctttgcatgtaaatacggtttaagcctgggcatcctatttgggcggatatagttacaatgccatatttcattcttgaggttggtcagcaagactttccatgaaacttctgctcccttattcccactta

SEQ ID NO: 1062 - DNA, 2766 bp, Homo sapiens
acacttcctttactccttaaagttaaccattttcacactaacttaaggccttttgttccaaatatccttgatactgtgctgtaacaactgagcacactcttaacctcctatcagttgactgtgtgcctttcttttaaaaattaggtctgtgtttcattttcagtgtttttgtctccctcctctctctcagggtctactatatgctgttatctctgtgccactgtaacctgctgtatgaccacataagtcaagcttctgtgacaattttttaaaaataagcataaacagctctgaggaaaggcctaacagtctaagaacaaagaccatagtcccctcggagggacctgatgacatacattttatggcttatttccagatcatggctctgcttgagaggtaggcaaagtccattaataagtgtccttgggatcagtgagaaaaatctccatcagcatttccaggtgcactagaaagttttgtgggtacttaccaaccaacagtgatagatccctgaaggggccagtttttccagttccaattgtgataccaaataaatatcatgtttaaggtcagcaaagtgaggtagaagtagggttactgctctaatgcagtgctctaaagtaagacctcaactttcctttttgttcattttaacagcacagccctttggcagggagcttcatgctccctggaatcctagtggggatgagaaacacaagagctcctttccctgtggaagcctctggattctgacacagcttcacctcttccccacagcctcacctctctaagccagtttcatgactataaaatgaggataatgaagtacctactgcccaccccagagcactttgtgccaaccaaacatgaaagagaacgtaaaagtgtgctgtgcactaacaggactccaggagatcagcattatcacagctcaaaggcaagcctggccaccaggcatccatggcaatctcatgccaggcaggaagttcctatgaagaaaaacaaagacacgaataccccttagctggaaggagagaaggtaagagcctccaagtgagaatggagtgatagtctgtgcttcctggacagaggaagtcgcaagaggaacggaaagcaggttttgaacagggagaaagcaaaagacctcagataagcaaagatgaggaagggacatgaggtccaaacgttgaataaagaaacagtaatactgggcactgtgggacgcctttgcatgtaaatacggtttaagcctgggcatcctatttgggcggatatagttacaatgccatatttcattcttgaggttggtcagcaagactttccatgaaacttctgctcccttattcccacttactgttccttatccataacgatagatgtgtattacatatacttcttacctgctgactggatcttctgtgatcacacctttcctaatagaatatttatccaggcctgagttccatagtcaaagaaggtagaagataatctgcttaaatgaagtgcctggccatttcattcacttctagaaatattttctcaagattaccatgcaagcaacagattttcaggaggcagaaaagatttctagactttgcccagagggagaactacaaatgccctcaggataaatagtgctccaatgagcagaagcccaaacaaaataggaaactgatagagaaccctagctctagatctttttgtcttataccatcctagcataagcagaagggagagaagctgttctaaccacgattgaagaatgaagctatttagcagcttaatcgaaactacgtacctttgaatctcttaattttaccaggctcttctacgtggacctatatttcggtaattataatggtaatgtggattgcgggaagatatcttcctcttatggctccccactccaagtctttgatttccaatcaaccaacaatttttttaagattatttatgttaatccttccactcttcattgcctcatttctaaactggagaagccctcatttcagtaacaacaacaacaaaagtgacatgtataggggtgtgtgtatatatgaaatcccaccatccttatgaaagtaatttttcccagttttctaggttcatgacgttaagaaagctgaacctcaccagagaatgtgtaatatgttaatatcccccaaaagccaaacattaaacattacttttattagctaaaatttattgaatgcttactatgtgtgccaagaaatgtgcttaactcttttttattattttttctgttggagacaatgtctcgctctattgcccaggctggagtacagtggcatgatctcagctcactgcaacctctgcttcctaggttcaagtgattctcgtgcctcagcctcccaagtcactgggactacaggcatgtaccaccatgctcagctaagttgtttttttttttttttttgtatttttagtagagacaggatttcatcatgttgcccaagggtctcaaactcctgaccccagggaattcacttgccttggcctcccaaagtgccgggattacaggtatcaaccaccatgcccggccctaagtgtgcttatctctttataggaattgcctaactaccgtacagtgcagaaggtactattattagcccaatttacaggtgaggaaactgaagacagagaatggaagagctaacgtttgaatctaggactgtctgactctgcccaagctcataatgactatgctacatcaattagtattattttctgtctcccatgccttcc

SEQ ID NO: 1063 - DNA, 2377 bp, Homo sapiens
cacgtggttctttatggttgaaataatgctatcctgtcctttagtattgcacagcaaaaaagcactgactttgcattcaaatacacagatggaggccgggtgcagtggctcctgcctgtaatcccaacacttagggaagccaaggcaggcagatcacttgaggtcaggagatcgagaccagcctggccatcatggcaaaaccctgtctttactaaaaatacaaaaattagccgggcatggtgacacacctgtaatcccagctacttgggaggctgaggcaggagaattgcgtgaacccaggaggcagaggttgcagtaagttgagatcatagcactgcactctagcctgggcaacagagcaagactgtctcaggaaaaaacaaaaaaggcaaatacatagttggatagtaaagcttcctagtttgttggacatactgctaccacatccccactcctcgttatcccctgcctgcttcatttattacctccagtcctgtgcatgtttaaaattacctgtctcagctcactagagtattaacttcaggagagcagggactttggttctctgctgtatccccagcaatagaaaagtacctgacacataatcctcaaaaggcatttgttgggttaaaaacaacaacaacagggccaggcacggtgactcacacctgtaatcccagcactttgggaggccgaggtgggcagatcaccaggtcaggatttcgagaccagtctggccaatatggtgaaaccccgtctctactaaaaatacaaaaattagccaggtgtggtggcatgcacctgtagtcccagctactcaggaggatgaggcagaagaattgcttgaacccaggaggcagaggttgcagtgagccgagatcatgccactgcactccagcctgtgtgacagagcgagattctgtccccccgccaccaaaagaaaagaaaaaaaggaaaaaaaaaaaaaaggcccacaaacttctaggggagcatggcaaatcaccattttatgaataatgttgataccagagaggctaagtgacttgtctaagtcaatatagtattttgactcctggcccagtgcagaggtattagaaatgaggatagaggagtgtgcgagaaattttggaaggaaatcaatagaccaaatcaataggccttggtgattaactagtcacaaagcttgaagaaggattattcaaaaaggacttgagggcttgaagctccactggctgggcaaacggtggcacccatgagaagagcaaggaaggctggaggctggggaagtcagaaagaacgtggagaaagaagtttgtttcccaaatgcaaagttaactgacttattatgaatattattttgccacaagcagaaatgcaataaatatatccaaatatttttgaagaaagaactctgtttgccagaagcattgtgtttattttatagcaggccacctctaaaaatcagacttcttgaataggagtgctcaagttgcatattctgtgcatgtgtgtggtttttcccattgtagctgggttgtatatgatggagaaaatttcactggtaatcaatacgtgttggaagaaggccattatccttgtctgtctgcaatgggatgcccgcctggagcaactttcaagtctcttcgttttatagatgttgtaagtatgtcattgtgaatagtgttgcagaaatgtatgcctcatatagctgatggtcagagtgaggtaaccagccggtagaacctgctcttaaagttagttaagggcttggagatggaactgtccatttggctctgtgtacatctagtttattgattctaactggtacacgttttccaccaccctgttttactcacttaatcctcatatgcatatccctatggacctgagtgggagtctcttggactatatattaggagtagaattactggatttcacatgtaagaacaggcagtttcattcagtactgccagatcccaccacttgagactcccaccagcagtacacattgttgccattactgaatattctctcattctaatttttgtcaacttgatagaatgagcagaaagcagtatgtcgtcattgggttaatttgtatttcactattagtgaggctggtatctcttatttataatttgcattttctattcaaggaattgtgtattgtatcctttgcaatttggcttcctctacctttggttgttattattgaagaaattccttataggtttttagtctattattattctgtgttttagagatttgcaatcaaatgacttctcccagtttgccactatgtgctaatccagattatagtgccctcttttggacagaagtctttcagtttgatgtagtggaagtaatattcaataga

SEQ ID NO: 1064 - DNA, 396 bp, Homo sapiens
ctaatgaccataatcatagtaagcagtggcatgacacagatatcaaaaagttgagtggcacttcctgtcacctgggacctgagctcacttgatgtccgttcttcacttgggctgaacagaataacatacatgtcatttacagcccgcttcgggatcccactgtggctgaaatgtcattgctaatcactcgtggccctccctcccactgagcatccatcgcagaacactcgcgtcagccactattggttggcactggcacccaggtgcaacccatcagctagctgcctgggtcatgttgccagtgccagcagtgttctgcgcccatccagtccacaggtcctctccagctgtgctttttccctttctcttctccatccttccctggggccttgcaga

SEQ ID NO: 1065 - DNA, 3594 bp, Homo sapiens
tccaagtttctctgattcacaagttctgtgactttaattcttcagatcctaaaagtcttttaggaggttcggatcgcatcttggtcattcctgactggaaactgggcaaagtggggcaagcttagcttgtgctgttttccaaatacccactgaacccgctatgcctcttggccatgggtaggaggtagagaaccaaagcccagagagccagtgcttctcctgaggtaacatcattgggcagtgacgagaggtcccacactgtatcatctgcctgtctcaaatctcagccacatgctgttgcttaaagagctggagccactgagggccaggtgggcccagatgtgggcactggtgccttgcccatctgagtttgagtcctctcctcactgcactgcctgctcccttggtcattttggacctcaaatttaaatttaacctctatgagcctcactttccttatcaataaaatagagataataaaacctgcattactggttgtgctggggattcaacagattacatgcaaagtgctcagcctaatgcccagtttaggagttttttgtttgttggttgttttttgagacagggtctcactctgttacccaggctggagtacaggggtgcaatcatggctcactgcagccttgacttcccaggctcaggtggttctcccacctcagcttcctgagcagctaagatggcaggcatgcactaccgtgcccagctaaattttgtttgtttgtttgtttgtttgcttgtttgtttgagatggagttttgcttttgttgcccaggatggagtgcaacggcaacatcttggctcactacaacctccacctcctgggctcaagcaattctcctgcctcagcctcccgagtagctgggattacaggcatgagccaccatgcccggctgattttgtatttttggtagagacagggtttctccttgttggtcaggctggtctctgactcccgacctcaggtgatccacccacctcagcctcccaaagtgctgggattacaggcttgagccactgcgcccagccctaattttttgtagagatgaggttttgccatgttgcccaggccggtctcaaactccggggctcaagagatccacttgccttggcctcccaaagtgctgggattacaggcatgagccaatgtgcccagccaatgcccagttcttagtaacactcactcaacagctgtcactgttaccatttcacacagcccaaagggcctggccacagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgacggagttacttatggggttactgggtgacagccattggtctatactggctggtggctggcatgtggagccatacatgcagggggtgagacctttttctccctcttcctctggatctgggtgtggtagcggccctgggtgagtgggtgtctacagactctacagacccaaatgttcccttgggtagagggtgcaaggcccagacaagacctgcttcctgctcacctagccaggacctaccatgacccctgatgagtaaaagaggtagtgtctgacccctgcctctgttatagtgggtagtcaggcattccccaccaggaatgtcaggtggccatcaggtgatggtcaggcagttgttaaactgtctctctaaaataatagttggtcacagctggcaattattgggaaaggcagtcagtctcccaatagaaaaaaacctaaaactggtgatcataagcttcccgacaagatctcaggagttgggcgagtgggctcaagcatatgcacgaagaggcaaaatggcagagtttacctggtatatggccttcctctgggaacttttgactggtgagggaaaaacgcctcaagtcagcatgtgcacaacgtcagtaaacacacggcgtgtgcggcccctcctaagtgctggcaggccactgtgcatgcaaacagcccaatccaaggggaagaatcagggagaggagacgcaaccccctggaagcataacatataaaactccaagtcggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactggggaggctgaggcaggagaatggcgtgaacccgggaggcggagcttgcagtgagccgagattgcgccactgcactcccgcctgggccacagagcgagactccgtctcaaaaaaaaaaaaaaaaaaaaaaaaactccaagtcaaagttcaaaccgtgcacttgatctctcaagtcgctcccttggtgctctccaagtgtactttacttcctttcattcctgctgtaacgctttttaataagctttcactcctgctctaactcttgcctcagtctctccctctgccttatgcccctcgtcaaattttttcttctgaggaggcaagaattgaggttgctgcagacctgtatggatttgctgccgcggacacctctgtctctcaaagattccagatttgggtcagtattaaccttttgagccccactggacattctctagggattcttattcagaaagtctgaggtagggctcaagcatctggatttttttttttttttttttttttttttgagatggagtttcactcttgttgcccaggctggagtgtagtggtgcaaacttggctcactgcaacctctgcctcccatgttcaagcgattctcctgctccagcctcccgagtagctgggattacaggcacccaccaccatgcccggctaatttttcgtatttttagtacagatggggtttcaccatgttggccaagcttgtctcaaactcctgacctcaggtgatcgacctgcctcggcctcccaaaatgctggaattacaggcgtgatccacccagtgagcatctggatttttaaaaagtatcatcggccgggtgcagtggctcacgcctgtaatcccagcactttgggaggccaaggcaggtggatcacaaagtcaggagatcgagaccatcctggctaacatggtgaaaccccatgtctactaaaaatacaaaaaaaaattagccgggcatggtagcctgtagccccagctactcgggaggctgaggcaggagaatggcgtgaatctgggaggtagagcttgcagtgagccaagatcgtgccactacactccagcctggacaacagagcaagactccatctcaaaaaacaaaaaaacaaaaaaacaaaaaaaagtatcttcggccattctgatacacagccacctccacctatgagcctcttctctggaggaattgagagctttgttaccagcggcgttcacatagaggctgggtgctatttgagtctcagtctcccatttataatatgaatgtctca

SEQ ID NO: 1066 - DNA, 7779 bp, Homo sapiens
tgccattttgtcacattttttccgttttagggtatataagcaaacatccgaattctctgaagataaaactttctgctgtgtacatatcaatgaattgttcagatacatggttatatagctagatttaggaggttggatgaataaagacagttctttatgctcctgatgaataaatgtttgtgtattaagaggtgaatagggggctggacgcagtggctcacacctataatcctagcactttgtgaggccaaggcggatggattgcctgagctcaggacttcgagatcagcctgggcaacatggcaaaacctcgtctctactaaaaatacaaaaattagccaggcatgattgcacatgactgtaatcctagatacttgggaggctgaggcactagaatcgcttgaacctgggagatggaggttgcagtgagccgagattgcaccactgcattccagcctaggtgacagagcaagactctgtcttaaaaaaaaaaaaaaaaaaaaggtgaataggggaagcacaaaatgtgtagttttgagaaaagcctattaaaggggacctaagaatggagagatttgcgaggagaggttgttggattttgagtagagttcctttgaacagtttgaaagagaccctagagctttcaggagaatggcaggagacatctccttcattctgctggtgctccactgctgcttgaggaaggcagtgttgttatgggaaataggagatggataataacacagcgatggggtgccgggattctgagcatttccttttggccctctttgactttgatttgcttttatttccattatccttggatactgaaaacttttcctcatttcaagttactgtcatctgtatttttttcttcttggatgtgtttgtttctttttcattcaaatcttttgctacctgaaggtgaaataaaaggttttggcaaatcaccaacctgggtggaggagaaaccgccctgggcattctgctgcttcgtgatccacttcacgatgttggttgcagaggtcaggtcctccgaggttggggctggctgggccgtgagataagcgaggagcacataggatgtcatctccacctcagcagagggagcctggggttcgtaaaaatgccccactggtgccttgggtttctgagggcgctcccaatggacagagttgtcttaaagatgagaaaaagatatttataagtgcctacatatttatatttaattcaaggtgaaagtacccaagccagtgctgaaatgagaattgcatgcccattataatcccctgtactgtatgtagatgcttttcccttcatgtaaatctgaatttggtgtgttttagcccagctaaggcagatattgatgctggagtcagaagcctatgcctatctatgttttcaaatcgttgctatagtcgggttggtgggagaaagaaatggcacagcagttgtctcattgagtctggctatttcctatttatgatgttatattagactatagctggagtttgttacatttcctataaagtgtgtctttatcagtttcttgtgaggatcacagatcacatgaaatagtagagtttctactcattaaattgaaaaaaaaaatacagtaatccttgaaataccaaaggctgacatggatgtgaaacaatgggaaccaatatacactgctgtgggaagccaactgctctttggcaatattcagcaatggggaagatgtgcttagcccactaatcagtcattatgcttctcaaagcataatttggagaaacacagatgcacaagaaaacaggcacatgagtattcattgcagcattttttttaatagcaaaacataaaaaaaatccatgaggagaaactcgatgtgtaaattatgactaatttatagactgtaatatattatgcagcagtgaaaattaatgagctgactctgcacatacttgtataggggtcttcatcaacatagtgttgaacttagaaaataaaaagcagacaaacaaaaaactaagctgctgaaatattcaaaaatgtttctcttgtttcttgaataagagagaaataaaaatcttgtttctctcaagatgaaacacatgtgaagattctaaatattagttagggatacatatgcagcaaaaatataaggaaatccatggaattgtaacgacaaattcaggataatgattgcctctggaggtggtagtgatacacaagggatttatttttcccatgtcggtaattttctatttcttaatctatgagagagttgtacagtgttttctagttatagcttatgcccttttgtatatctattataaaatatttctcaatacattttaagaagaattaatggctgtcaaaggaaaaaggtagactgttttaatggacatcttgtgatttgcattttattttctatttcttcaaccgctcatatagaccatggtatatgtagaagtactgtgtgaatatgagtagattggtcaacattattggtcttatgaaatgggcttaaaataccagaattcattcaaggagttacttccatgattattttcttatgtttaaggttatataatgtaccaggtaagggttgggcatatattgagaactgatatgttaattgtaataactagtacttttataggatttgctatgtgacatgtactctactaagtgttttacgtgtaccaattcatttattacaacagctctgtgaggtaaatactattattatccccattttactgatgaaggaactgaaacacaaggaagttaatgactttcccaagctcacataggtagcacattttggagctagtctccagagaatgctcttcttaccagcatactatagagatggtccctgacttacaatggtcccacttaagattttttagactttacaatgagtttgtcaggatataaccccatcgtaattgagaagcatctgcacggcctcttgtcttctgatttctgatttgattaagaaatcctagattttataagatgcaatatggacaaaatatatatgatatatagaaaagaagagaggagacagggatcacaggaggtaggagtgagggatttttgccatgcagttcttgatacagaggatgggccaggagaaggatctcaggtgtgctctcacctttcttcacagcttcctcattaagtgacttgagtacttccttcctcttgtcctggttacctgccagggcaaaagcataggccagcagtgctttggtatatacatggctgccatggtccccttcttgtgctgtcttccaggctgactccaggcaaaacagggcattgcggacaacagggtgctgtgaaggcagaacaagaagggaactaagctatgtaaacaggcatattagcattcccaggcaaatacacggatcacagcacagaagtttttcaaacgcatttttccaacgattcctcattcttatcaatagatataatattatttttatctgttattctcacattcaaaagatacatctttaagattcttttttgagtggtggtggtaaatagcctaggggaattactgggaaaatttaaacctttcttaatgggctgaccaaattctctgtagatctgggaagcactggcattgcatagaaagaaagctgatgctttgcttttaataggatagtatttcagacagcaggtcagcagtttcattgcatccagaactctccttcagcagaggaatggggtggtacctacagtgactgtgagaggaatctccagaagggcgatggtgatataggcggagagggtcacttcatcttctactcctccctgtgaatacgagagagagatctgaataattcaacttctgagaatgctattgattagttctttctattctgctgtgtcatggaattcatccttacccatatccatccctatagggcaaagtatcacaatcaacttttgttctatcccctcttttttggtgccatccaggttttattttcctctgaggctttcccttagaatttttcacattatcacttcctatcctcatccttgcagatatcataatggacaaatcaaaactagctccagaatgattcacctttatggcattgttgagcagtgacccagagctcctgaaacagccattgtccttctgcctctgggagagccatatgagggcttgggtaatgtgtgcttcatcgatgaagatgtaggctcgagcttgggcaaaagtcttcagaacaaaggctgtgagcctgaccagggaggaagcaatcatgatgtttatgttgtcaaaatggttttataaccacttcacagcaacaggcttcatatgatgtgagttagctaacaaaattcttgtgtacttagagagcttatctccttgattaatctttagtctgcctgattaatctgctagatgtagtatttccttgctaactctctctttgccacagggagtcttagtatatttaattttattttagttccgagatacatgtgcagaacgtgcaggtttgttacataagtatacgtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgagtgagaaatgtggtgtttggttttctgttcctgtgttagtttgctgaggctgatggcttccagcttcatccatgtccctgcaaaggacatgatttcatttctttttattgctgcatagtattccatgatgtatatgtaccacattttctttatccagtctgtcattgatgagcatttgggttagttccatgactttgttattgtaaatagtgccgcgataaacatacatgtgcatgtgtcattatagtagaatgatttatattcctttgggtatatacccagtaatgggattactaggtcaaatggtatttctggttctagatccttgaagaatcgccatactgtcttccacaatggttgaacaaatttacattcaagtaatttgaatgtacttatttttgttagttacttgagtaaggctttaaatctctcttatctttagagatttccttctgcagatgacagaatcttctcacatgcagctcttacatgcagtaaattttaatattgctttactttagggatttaaaaaaatgttttatattactgtttccttctcaattgtttcctcttattaatgaattcattccaagtcaagctgaatgacttagaatgtgacaatataagctgaagttaacatggtttatctggaagttatatatgttcactggcaatatcattttaaaactcatggttatggtagctactttagaaagaatagccatttcagaaagaaaaccttggtacattattaataggatccattttggaaacaagcctaacataacatgtatttggatatcaggttttcttctgattaccttgctaatcttggtggatttatctagtataacaaaccatcggtctgataatacatatctgatagtgttgctgtgaatataattgaggtaatacatgtaaaagagctggcacacaaaaagaagctcaaaaaattgttctttccttaccaggtgttgccctggttcctgccatatcgctccccaaaggtgctgtaggagccatcatagtgtttgtagttcaactgtctctggtaacctggaaaggaagattaacgaaacagcacaatggattaatgtgcatgctgagggtggagaaattactaaaagtaccttggcttctcttgtgacatttcttaaattttgttgtcatagattaggagtttctgagccttaaatattttattggaggttggagagtggatagtttccttgaaattaactatcatagcagctatcatagtgagctaagctaatgtatcataatattcataagtaactgaaacctactgggaaatccagttgaaataacattcaagttttcccttactcaagtaatcactcaccagtgttgagatagccaatggccttggacttgatctctggagtaagctgctgtgtttcatttagataatccagtacatagatgttaggagcaaagaggaccatattctgctctccacagccatagggcatctggagaagattttgtgtgttttgcatggcagagcctaatatgtctcctagagaatgggagagatgggaagtcataaagcttggagattatcatctatcaaagtcattaagcagaaataattagttgagcttagaaattgagaatttttaggaaggatgattcttccagggatagaagtatgattgaaagcaataaacaagcccaaagaagaagagaagaaagaagttaaaattatagtattatttttagtaaatatttatgggaaataaaaatagtataatagaagctgttaatgcccggatccactaggggctggagactcacccaaaactgagacagaagctcgggcagattcttctaccacatttggtggcagtttcagggataattcttcagaaacctcaccacctagagaaataagcaaatcagacatatgaaaattatttctgcattatatctttctaaacagctctatgacccagaagctaggactatgccttatacctaaactcctcctgaaaagttgtccgcctttaatacaacagtaatatataaatatcttaaaaatgggctactggtttcctgtgattttcagaatttcttcttcaatgatcttttcagtaatttatgtagaatcgcatgccaaataagacaacaaattgtaagagcctggtgatgttgtgattcagttgctgtcatctgatggctgacacaagacggttatcacaagatgatctatttagttcccaccaccaacttccttactcaacagttgtatggagaaaacaccaacaacaaagccctataagtatacataagtaaaattacccacaaaaggtcctgaattctataataatgctatgttctttcttcaaatttcatatacaaagatagtatttttatggaaaacctagaaaattgagggtaaggaagtgaagacgaacagtatttgatgcattgaaaataaaataattactactcatgaacatacatttacttccattttaatcttggtaaattatatgaaatgaaaatgagagaagtatggtatttattttcatactgaatcccttcctcataaaattcatattaaaatgtttcttaaaaaaaagccataagcatagttaaaggacaaatggctaagcaaaataaaatgcttgactcactgaaaataaaataactgctactgatgaacatacatttactacaattttagtattggtgaattatatacaaatgaaaaatgtagcagttatcttccctttctcataaaattaatgttaaaacttttgtaaaaaaacagatgccataaacaaagttaaaaaaatgaccaagtgaaagaaaatatctgcaacatattcaacagataaagaattagtgtcatacaactgagtcagaaaaaaactactcaaaagacaaatagccaaagattataaaggcaattaataaacatgcaaaaataaggtcatccttgtaattaagaaaatataaattaaaacaacagcaaaatttttttttctaaatttttggcaaaaattaaaattaaaaactttgatggtaacagatgatggcaaatataacactatggaaatgtatcctggtggaagtataaat

SEQ ID NO: 1067 - DNA, 14603 bp, Homo sapiens
tgccattttgtcacattttttccgttttagggtatataagcaaacatccgaattctctgaagataaaactttctgctgtgtacatatcaatgaattgttcagatacatggttatatagctagatttaggaggttggatgaataaagacagttctttatgctcctgatgaataaatgtttgtgtattaagaggtgaatagggggctggacgcagtggctcacacctataatcctagcactttgtgaggccaaggcggatggattgcctgagctcaggacttcgagatcagcctgggcaacatggcaaaacctcgtctctactaaaaatacaaaaattagccaggcatgattgcacatgactgtaatcctagatacttgggaggctgaggcactagaatcgcttgaacctgggagatggaggttgcagtgagccgagattgcaccactgcattccagcctaggtgacagagcaagactctgtcttaaaaaaaaaaaaaaaaaaaaggtgaataggggaagcacaaaatgtgtagttttgagaaaagcctattaaaggggacctaagaatggagagatttgcgaggagaggttgttggattttgagtagagttcctttgaacagtttgaaagagaccctagagctttcaggagaatggcaggagacatctccttcattctgctggtgctccactgctgcttgaggaaggcagtgttgttatgggaaataggagatggataataacacagcgatggggtgccgggattctgagcatttccttttggccctctttgactttgatttgcttttatttccattatccttggatactgaaaacttttcctcatttcaagttactgtcatctgtatttttttcttcttggatgtgtttgtttctttttcattcaaatcttttgctacctgaaggtgaaataaaaggttttggcaaatcaccaacctgggtggaggagaaaccgccctgggcattctgctgcttcgtgatccacttcacgatgttggttgcagaggtcaggtcctccgaggttggggctggctgggccgtgagataagcgaggagcacataggatgtcatctccacctcagcagagggagcctggggttcgtaaaaatgccccactggtgccttgggtttctgagggcgctcccaatggacagagttgtcttaaagatgagaaaaagatatttataagtgcctacatatttatatttaattcaaggtgaaagtacccaagccagtgctgaaatgagaattgcatgcccattataatcccctgtactgtatgtagatgcttttcccttcatgtaaatctgaatttggtgtgttttagcccagctaaggcagatattgatgctggagtcagaagcctatgcctatctatgttttcaaatcgttgctatagtcgggttggtgggagaaagaaatggcacagcagttgtctcattgagtctggctatttcctatttatgatgttatattagactatagctggagtttgttacatttcctataaagtgtgtctttatcagtttcttgtgaggatcacagatcacatgaaatagtagagtttctactcattaaattgaaaaaaaaaatacagtaatccttgaaataccaaaggctgacatggatgtgaaacaatgggaaccaatatacactgctgtgggaagccaactgctctttggcaatattcagcaatggggaagatgtgcttagcccactaatcagtcattatgcttctcaaagcataatttggagaaacacagatgcacaagaaaacaggcacatgagtattcattgcagcattttttttaatagcaaaacataaaaaaaatccatgaggagaaactcgatgtgtaaattatgactaatttatagactgtaatatattatgcagcagtgaaaattaatgagctgactctgcacatacttgtataggggtcttcatcaacatagtgttgaacttagaaaataaaaagcagacaaacaaaaaactaagctgctgaaatattcaaaaatgtttctcttgtttcttgaataagagagaaataaaaatcttgtttctctcaagatgaaacacatgtgaagattctaaatattagttagggatacatatgcagcaaaaatataaggaaatccatggaattgtaacgacaaattcaggataatgattgcctctggaggtggtagtgatacacaagggatttatttttcccatgtcggtaattttctatttcttaatctatgagagagttgtacagtgttttctagttatagcttatgcccttttgtatatctattataaaatatttctcaatacattttaagaagaattaatggctgtcaaaggaaaaaggtagactgttttaatggacatcttgtgatttgcattttattttctatttcttcaaccgctcatatagaccatggtatatgtagaagtactgtgtgaatatgagtagattggtcaacattattggtcttatgaaatgggcttaaaataccagaattcattcaaggagttacttccatgattattttcttatgtttaaggttatataatgtaccaggtaagggttgggcatatattgagaactgatatgttaattgtaataactagtacttttataggatttgctatgtgacatgtactctactaagtgttttacgtgtaccaattcatttattacaacagctctgtgaggtaaatactattattatccccattttactgatgaaggaactgaaacacaaggaagttaatgactttcccaagctcacataggtagcacattttggagctagtctccagagaatgctcttcttaccagcatactatagagatggtccctgacttacaatggtcccacttaagattttttagactttacaatgagtttgtcaggatataaccccatcgtaattgagaagcatctgcacggcctcttgtcttctgatttctgatttgattaagaaatcctagattttataagatgcaatatggacaaaatatatatgatatatagaaaagaagagaggagacagggatcacaggaggtaggagtgagggatttttgccatgcagttcttgatacagaggatgggccaggagaaggatctcaggtgtgctctcacctttcttcacagcttcctcattaagtgacttgagtacttccttcctcttgtcctggttacctgccagggcaaaagcataggccagcagtgctttggtatatacatggctgccatggtccccttcttgtgctgtcttccaggctgactccaggcaaaacagggcattgcggacaacagggtgctgtgaaggcagaacaagaagggaactaagctatgtaaacaggcatattagcattcccaggcaaatacacggatcacagcacagaagtttttcaaacgcatttttccaacgattcctcattcttatcaatagatataatattatttttatctgttattctcacattcaaaagatacatctttaagattcttttttgagtggtggtggtaaatagcctaggggaattactgggaaaatttaaacctttcttaatgggctgaccaaattctctgtagatctgggaagcactggcattgcatagaaagaaagctgatgctttgcttttaataggatagtatttcagacagcaggtcagcagtttcattgcatccagaactctccttcagcagaggaatggggtggtacctacagtgactgtgagaggaatctccagaagggcgatggtgatataggcggagagggtcacttcatcttctactcctccctgtgaatacgagagagagatctgaataattcaacttctgagaatgctattgattagttctttctattctgctgtgtcatggaattcatccttacccatatccatccctatagggcaaagtatcacaatcaacttttgttctatcccctcttttttggtgccatccaggttttattttcctctgaggctttcccttagaatttttcacattatcacttcctatcctcatccttgcagatatcataatggacaaatcaaaactagctccagaatgattcacctttatggcattgttgagcagtgacccagagctcctgaaacagccattgtccttctgcctctgggagagccatatgagggcttgggtaatgtgtgcttcatcgatgaagatgtaggctcgagcttgggcaaaagtcttcagaacaaaggctgtgagcctgaccagggaggaagcaatcatgatgtttatgttgtcaaaatggttttataaccacttcacagcaacaggcttcatatgatgtgagttagctaacaaaattcttgtgtacttagagagcttatctccttgattaatctttagtctgcctgattaatctgctagatgtagtatttccttgctaactctctctttgccacagggagtcttagtatatttaattttattttagttccgagatacatgtgcagaacgtgcaggtttgttacataagtatacgtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgagtgagaaatgtggtgtttggttttctgttcctgtgttagtttgctgaggctgatggcttccagcttcatccatgtccctgcaaaggacatgatttcatttctttttattgctgcatagtattccatgatgtatatgtaccacattttctttatccagtctgtcattgatgagcatttgggttagttccatgactttgttattgtaaatagtgccgcgataaacatacatgtgcatgtgtcattatagtagaatgatttatattcctttgggtatatacccagtaatgggattactaggtcaaatggtatttctggttctagatccttgaagaatcgccatactgtcttccacaatggttgaacaaatttacattcaagtaatttgaatgtacttatttttgttagttacttgagtaaggctttaaatctctcttatctttagagatttccttctgcagatgacagaatcttctcacatgcagctcttacatgcagtaaattttaatattgctttactttagggatttaaaaaaatgttttatattactgtttccttctcaattgtttcctcttattaatgaattcattccaagtcaagctgaatgacttagaatgtgacaatataagctgaagttaacatggtttatctggaagttatatatgttcactggcaatatcattttaaaactcatggttatggtagctactttagaaagaatagccatttcagaaagaaaaccttggtacattattaataggatccattttggaaacaagcctaacataacatgtatttggatatcaggttttcttctgattaccttgctaatcttggtggatttatctagtataacaaaccatcggtctgataatacatatctgatagtgttgctgtgaatataattgaggtaatacatgtaaaagagctggcacacaaaaagaagctcaaaaaattgttctttccttaccaggtgttgccctggttcctgccatatcgctccccaaaggtgctgtaggagccatcatagtgtttgtagttcaactgtctctggtaacctggaaaggaagattaacgaaacagcacaatggattaatgtgcatgctgagggtggagaaattactaaaagtaccttggcttctcttgtgacatttcttaaattttgttgtcatagattaggagtttctgagccttaaatattttattggaggttggagagtggatagtttccttgaaattaactatcatagcagctatcatagtgagctaagctaatgtatcataatattcataagtaactgaaacctactgggaaatccagttgaaataacattcaagttttcccttactcaagtaatcactcaccagtgttgagatagccaatggccttggacttgatctctggagtaagctgctgtgtttcatttagataatccagtacatagatgttaggagcaaagaggaccatattctgctctccacagccatagggcatctggagaagattttgtgtgttttgcatggcagagcctaatatgtctcctagagaatgggagagatgggaagtcataaagcttggagattatcatctatcaaagtcattaagcagaaataattagttgagcttagaaattgagaatttttaggaaggatgattcttccagggatagaagtatgattgaaagcaataaacaagcccaaagaagaagagaagaaagaagttaaaattatagtattatttttagtaaatatttatgggaaataaaaatagtataatagaagctgttaatgcccggatccactaggggctggagactcacccaaaactgagacagaagctcgggcagattcttctaccacatttggtggcagtttcagggataattcttcagaaacctcaccacctagagaaataagcaaatcagacatatgaaaattatttctgcattatatctttctaaacagctctatgacccagaagctaggactatgccttatacctaaactcctcctgaaaagttgtccgcctttaatacaacagtaatatataaatatcttaaaaatgggctactggtttcctgtgattttcagaatttcttcttcaatgatcttttcagtaatttatgtagaatcgcatgccaaataagacaacaaattgtaagagcctggtgatgttgtgattcagttgctgtcatctgatggctgacacaagacggttatcacaagatgatctatttagttcccaccaccaacttccttactcaacagttgtatggagaaaacaccaacaacaaagccctataagtatacataagtaaaattacccacaaaaggtcctgaattctataataatgctatgttctttcttcaaatttcatatacaaagatagtatttttatggaaaacctagaaaattgagggtaaggaagtgaagacgaacagtatttgatgcattgaaaataaaataattactactcatgaacatacatttacttccattttaatcttggtaaattatatgaaatgaaaatgagagaagtatggtatttattttcatactgaatcccttcctcataaaattcatattaaaatgtttcttaaaaaaaagccataagcatagttaaaggacaaatggctaagcaaaataaaatgcttgactcactgaaaataaaataactgctactgatgaacatacatttactacaattttagtattggtgaattatatacaaatgaaaaatgtagcagttatcttccctttctcataaaattaatgttaaaacttttgtaaaaaaacagatgccataaacaaagttaaaaaaatgaccaagtgaaagaaaatatctgcaacatattcaacagataaagaattagtgtcatacaactgagtcagaaaaaaactactcaaaagacaaatagccaaagattataaaggcaattaataaacatgcaaaaataaggtcatccttgtaattaagaaaatataaattaaaacaacagcaaaatttttttttctaaatttttggcaaaaattaaaattaaaaactttgatggtaacagatgatggcaaatataacactatggaaatgtatcctggtggaagtataaatgcatttaggtaataaagaggaggattttcgttttgtagttcaattaaaattcagaataaagcaagatgatggactagaaagtctcaggatcttcctccctccacagaaagtccaactagctgctatccacagatcagaaaatctattttgaaaaccccaatacttggaaacaagtctaggacacctacattgttcatagaactgagtgaagacaaattagaagagtaggaagaatggtctcactttgaccatgtcattgttcccactcctttaggttagcacaatgccagatagagaggagttccctggggtcacagtttctacagcggggaagagaaccaggggtagacatcaagattctcaagtattcaaagacacttctcaggaagcccactctggtctcatttcaccgggaacacaggaagtaatgaggtcaggtagaaacaaagaaggacagagctcacagtgaccagcatgtggattttggtagtgcttctgtgtttctgccagctatggcacccattcagagataccagccaactgcatagcccatctgcaaaactgagctggtcactttcagaagcatgttgggaagttcaacctagcttgagtttccagatggccagtctgtaagcccagcttcagaggttatgccagtgaccccacccaggtagcagacaccacctctgtgtatttcatagaagtgtaggggttaaatatgcttgacctgggagtctaaagggtagctcaactcagccaaaacctcactccatggctccattcacaagggtggggtagcaatcctctattatgcacatctaagaagtatagtatttatttctgcccatcccaagcaacaactctacctaacctcacagcccggattgtgaccctgcctaacttcaggtcccaaatagcagaatcatccagccaggcaacacatcttgtgactggcctgaccagaggccattgtagtacccagccagcagctccaccagatagcagagacaaaacagtgatcttgccagagagcaaggcccaaccagtggccctaccaaacataagagcaaaggcagtggcccagccaactagggaacccatgaaaactctgcctgctcaaggttgtcaccaactgatctttccagaattataggctagactaaatagcaaacctttatccctgccaaagaatacctataaaaaccagaagaagtggctttctcctcaaatgcacaaataatgcaaggacacaggattatgaagaatcaaggaatgatgacacctccaaaagaaactggccaagctcaaaaaattgacctcatagaaataaagatctatgaaatcactgacaaagaattcagaataatcctcttgaagaaattcagtggactacaagaatatataaatacaaaattaaatgaaatttgcaaaacaatacaccaacaaactgagaagtttgacatagaaacgattgtgaatagtgccacaataaacatatgtgtgcatgtgtctttatagcagcatgatttataatcctttgggtatatacccagtaatgggatggctgggtcaaatgtatttctagttctagatccctgaggaatcgccacattgacttccacagtggttgaactagtttatagtcccaccaacagtgtaaaagtgttcctatttctccacatcctctccagcacctgttgtttcctgggacatggatgaagctggaaaccatcattctcagcaaactattgcaaggacagaaaaacaaacaccgcatgttctcactcataggtgggaattgaacaatgagaacacttggacacaggaaggggaacatcacacaccggggcctgttgtggggtgaggggatgggggagggatagcattaggagatatagctaatgtaaatgacgagttaatgggtgcagcacaccaacatggcacatgtatacatatgtaataaacctgcacattgtgcacatgtaccctagaacttaaagtataaaaaaaaaagaaatagaaacaattatctgcaacttagctaatattgtaaaataaaaaataaatagaaacaatcaaaaagaaaccaaatagaaatcctggaaataaagaatacaatgactaaaattaaaaattcaaagtaagctcaacagcagacttgatcaagcagaagaatcagtgagctcaaagatagagtatttggaattatccaggcagaagagcagaaagacaaaagaatgaagaaagcctatggaaattatgggacatcatcatgaaatcaaacctttgcattaaagaaagtccagaagaagaagaaagagactataaagcacatttaaagcaataatgaaaaaaaagagtatagaatcagaaaaaaaaaaaagcagtaagggctgaaaacttccctaattaggggatagatgctagcatccaagtacaggaggcacagaggtctccagtgaaattcaaatgaaagaactgctcactaagacacaataattaaactatcaaaaatcaaagacaaaaaaaaattctgaaaagcagaaggtgataaagaaacatatcacatacaaaggaattccaatacaactatccatggatttttagcagtaacccggcaggctgagggagagtggaataatatattcaaagtactgaaggaaaacaaaaataaaaacaacatggaatcaagaattcttcatccagcaaagctgtctttcagaaatgagggagaaataaaacattcccagacaaactaaaagctaagggagtcgtcaacattaggcctgccttcaggaattactgaagggagttctttaagctgaaacaaaaggcccctaattaataatacaaaaacacaaaagcacaaaatttaatggtataagtaatatagagccatattcaaaatactctatgactgtaatgatggtatttaaagcaattttatctctagtacaagggttaaaagacaaaatattaataacaagcatagctaaaaataaattgtcaataaatacacattacaaaatatgtaaattctgacatcaacgacataaaatgtgtgtgggggagtgaaagaatgcaaagttaagttgttatcagcttgaaattgactgtaaaccccatagtaacagcaaggcaaaaatctttaatagaagcacagaacaaaaattttaaaagattcaaatcataccactacagaacatcagaccacaaaggaagacagcaaaagaggaacaaagaagcaaaacaaccagaaaacaacaaaatggtagtaccaagtcatttttaaattaataattaccttgaatgcaaatggactaaattccccatttaaaagacataaagtgactgaatggatttaaaaaaacaggaccgaaacatatgctaattacaagagactcacctaatttttaaggacacacatagactgaaagtgaagagaaggaaaaagatgttctaggtaaatggggactaaaagagagcaggggtagctatacttatattcaacaaaacagacttaaagtcaaaaactgtacaaagagacaaaggagaacattatataatgataaaagggtcaattcatcaaaaggatataacaattgtaaatctatacatatccaacattggagcacctaaatatataaaacaaatattaaaggttgaagggagagatatgttgcaatgcagtaatatcagggaatttcaacatctcacttttaaaaatggatagattatccagaaagaaaattaataagaaaacgttgaacttgaccaacactttagatcaaatagacctaatggatacatacagaacatttcatctcaagcacacaagaaacattctccaagatagatcatattttagcccacaaaacaagtcttagcaaatttaagaagactgaaatcgtttcatcgtatcaagtatcttttctgaccacaatactatgaaaactagaaatgagtaacaggaggaattagaaaaaattcacaaatatatgaaaattaaatgacatgctcctgaacagccaatgggtcaataaagaaatttaaaaggaaattcaaaaatatcttaagacaaatgaacatggaaatggagcataacaaaacatagcataaagtaaaagcaattctaagaggaaagcttataacaataaacaccaaaaaagaagaaaaatttccaataaagatactaatgatattcctcagagaagtaggaaaagaagaacaaagtaagctcaaaattggcagaagaaaggaaaataataaagattagagcagaaataaatcaaatagagactagaaaaagaatacaaaagatcaatgaaactgaattgtttttttaaaaagacagacaaaaacttttagctaggttagctaagaaaaaagagggaggccttaaatatataaaatcagaaatgaaagagaaattatggctgataccacagaaatacaaaggatcataagagactattatgcataagtatacaccaataaattggatgatctagaagaaatgaatgcattcctagacatatacatactaccaagactgaatcatgaagaaatagaaaatctgaactgacaaataatgagtaaagagattgaatcagtaataaaaagttttccattaaagaaaagcctaataactgttggcttcactgctaggttctacttatcatttaaaaagaatgaataccaatccttctcaaactctgccaaaagctggaagaggaaggaatactttcaagctcattttatgaggcaagcattaccctgataccaatgtcataaaaagacattacaaaaaagaattacagaccaatattcttgatgaatatagatgcaaaaatcctcaataaaatactagcatagcagctaagcatggtggcatacacctgtgggtggctgaggtggtaggattgcttgaactcaggagttcaagtccagcctggggaacacagcaaaagctcatcacttaaaaaactaaaccaaccaaccaaccacacgaaataaactagcagactaaatccaacaatacagtaaaaggatcatctacctagtcaagtgggatttatccctgagatgcaaaaattgttcaacatatgcatatcaataaatgtgatacattacatttacagaatgaagggtaaaaaccataccatcatcttgttagatggagaaaaagtatttgacagaattcaatgctcttttatgataaaactctcaccaaattagatatacaagcaatgttcctcaacacaataaagggcatgtatgataaacctatagcttacatatttaacagtggaaaattgaaagactttcctttaagatctggaacaagacaaggatacccactgccaccatttattttcaaagtagcactggaagtagcagcaagagcaatcaaacatgaaaaagaaatgaaaaatatccaaattgacaaggaagaagtaaaattttcactgttggtgatgacattatcttatatattggaagctcaaaagacttcaccaaagggctgcaagaacttataaatgaatgcaataaagttgcaagatacaaaattaacacataaaaatcagtagtattttctgttcactaacaatgaatgattgagaaagaaataaaaacaatcccatttacaatagctataaacaatatgtagaaataaatctaatcaaggaggtgaaatgtacagtgaaaattataaaacactgatgaaagaaatcaaagagaacacaaataaatgaaaaaaaatacaatgttcatggattggaagaattaatactgttaaaatgtccacactacccaaagcaatctacatattgaatgtaatccctaacaaattactgatgtctagttatggaatcataagtgtcatcaacagatgaacagataaagaaaatttggtatatacacatagaattccattccattttaaaaaacaagaacattctgctatttatggcagcatgattaaatctggaggagattatgttatgtgaaataagccaggtataggaaaacaaatattgcatgttctcatttgtatgtggaagctaaaacattcaaattcacaggagcagagagtagaatggtggttatggaggatgaagctggagtaaaaggaaggtggtgttcaagggacacaaagtctcagacagaaggaatacatttttttctttttgggatctattgcacagcatggtgaatatagttaataatagtgtattttatgtttcaaacttgcttagagaatttcaaatgttcccaccacaaaacataagtatttcaggttagcttgatttaattatttcacattttattcataaatcataacatcactttgtatgctgtatatatatacaattataaatggtcagtttacaatgtaattaaagaacaacaacaacaaccaaccaaacaaaactatgcatatctatgcatatgctctctgactcaggaatttaacattttggatctaccctagctgtacttgcatatgttcattaagaggctcttattataattaactaactaattttttaaagctagtgaatagttgaaaaaaccaatataggaagactaaaacactaagcagaattgtgatgtatttatattataggcttaaaagcaattccaaggaaagacctagatctacaatttaacataggtaaatctccaagacaggatgctgagtgaaaaacaaacagtgatttatagaatgaaacttatacagtttattatatgtaaatcacacatccacaaacatatacatctacacacattatttctaaagataaatggatggcaaagta

SEQ ID NO: 1068 - DNA, 2570 bp, Homo sapiens
taaccaagaagacgatgttcagatcttctgtgacataaattaccattgttttgctttcccacaacgtgaacattttttaaatgctggtttgagaaccaccatcacaacaaaggatgttaatgtgttaggttttttcttttaatataaaacagacctacttgcatatttttttctagtttagcagttattatgcatctactgacttggttagctactgaaatcaagaatcctttaaaccaagagaaaaggagaaaatactaaaaacaaaacaataaattaaagagctctggggtgtgtttggattattttcttgtcatgattcttgggtgtggtgacacttgttggcttttctatgtggttttattaaggactttgtgtacatttccatgttgttcagcttatggcgtcttgcctttgttgtacccggagttcattgtgcatgtaggatgaactttctcacagtcatgcctatgtaaagtgccaaccaaatggcttggctgcttcttctatatctgctgtacctacatactctcaattacagtactaggcaagagcataggcaatggaaagttgtctttataggattttccttgggatgagttttgtagcagaataaatagcagataaaatagtgcacatcatacttgggcaatgtaattactgtttatttgtgaagataattaaaaaaccaaacatttgctcaaggtttgaaaaacatttgagagtgaattgaggcagtcagttactttctgtccctgaggtaagatcactgagcttaggttaagatacctcacaagctgatttggtcttctttcctcggcttcacttatgtggctatagcttcaggaatctgagattgtcagaataattagttgtgggtttgtttgcttctttgttttctgaaagtaattttagaccagatggctagtcataaatttattcactcattcaagaactagtcatttagcatctatgtgggtcagttctgtgctgaacaattgatatacaatggtgcacgatcttccttgtcttcaaaaaggatgtagtctagtggggaacatagaccactatatacacaattgtaattcagcgtgctaaggattaagtataggggccaggtagtgttaaattgggtgcacctgacctatttgggtatattgagagaggttgcccagaagaaatcatagtaaaactgagacaaatgctagtaattaacaagcaaaagaggtaaaataaaaagaagaaaatacggagtattcaaagcagagggctcacttttgcaaaaagtcagagttagtagttaagattcaaagtctgccatgctgtcctggtgaagttctaataacaaacatacacttccttcccagttttccttattgcatggctcagaatgaactcttatttcatactcattcttactatatagcattgcctttggttatcacaaatagtcaccaggcttttccctgaaagtaaatgggtttcattaggagcagatgtaattctaatctgtagagtctgtaaaacattcaagggattatttggattaaagaactctaagttttaaggggaaaaatattatcattattttaataatactttcccaagtcgcaaacgaataactggctccaacaatcacatcactgtaattgttcacacatttcaggcaggcattttacagccacacaaagaaacttcaacagctaagctcctctgatttgattgctagagagactcaaaatttctgttttagtgccaaaaatcgaatcactagagcaaaagttagacaggaaaggctgaacttgaacaaaagttcagtggttttataaagtgtgctattattgaatctcatcaaatttaagatgtattagttgtaatgtgcactattttatgtaacattaacaataaatacataacacactgccatttaaactatgacatgctatcagctgtaagaccttctcctgtttaatttcagagagattaacatgtgaaatgatgtctatcttagaatctgtgaatcatggctaacaacaataaatatttctatgaagtctaatgggtatttcttctatatgataaaaaaatcaaaatgaaaaatagaaaatcaagtcagacatttgaaggctttgtgtttgagattggaagtgttggaaggaacatgatagaaaatagaaaattagaccttaaaataggcattccagtctcttgagcacattaaaaatccctattacttaagggagatttgctatgcactgaatctgaaaaacagaaggggtaggaaaacataaagatattgtcagcttcctcttacctccatcaaacagaatcatagtgtcattaaattaaattcttttgatcttcagcactttttgaaagatttttgtgctctatggttgtaaatgtatacacataaaactaatagttatggtagagtgactataggaaaagaaataattagtgagaaactttgggaaaatggtggaagaataaccaaaagatagaaaatgtgaataacttttacttatctgttactggctattgagcaatagatgaagatgagctgagta

SEQ ID NO: 1069 - DNA, 7376 bp, Homo sapiens
aattacgaccataacaacagtggtaattagtatttgttaagaattcatgctggtcaatggttatctcatttaattttcaccagaacttttgtggattaattaccattgttaccttcatattatagtggaaggaagggagatttctgagggttaagcatcttgcccaagattacacggctagtatgtagcaaaggtagaaattcaactctggccaactgaccacgctcttaacttcatgctctggagatctttctctagtctaactcatctgctgagaggttgtccagcttgtgtgttaacacctgatggggaactctcttcttcatcagggtaatgaatttcagctcttgaatttcatgatagaaataaatgaccctgtctctctgcagtcatgcattggttttagccaaactatttgggctcatgaagaaaatgtcttgcctgtgttttccatgacagacctccaaatatttgacaataattatcactctggaatctcacattctttcatcccgcactcaagtcatctcctctctaattctatcagcagattcttatatgatagtcatttcactcttaaccatcattcttcttcaaatacacagcatttatcagtgatgcttttttggcaagccaaattgatggaatccaccaggaatgggccagctggtaaagattacaacacataaacaccttcctccttgtataggctgcctaataggtgatagtgtgtgatggaaagagccaaggctttggagtcagacagacctgaatttggctggtgtttcactatttctactccttcctagctctgtgccttagggaataggcttcatccttatttttttttttccatgaggaaggtagggatgggaaatatccaccttagaaggtgtattaaagatgtaaggtgggcatctggctctatgctcggactccaggaaaatatgctgttttattattgtaatttttagttggccatcttgcacatttctctaagtaaaaggcatatgcagacaagtcaagaatgtgctcagccatttcaggatactgttgctaggagagtttgtttgttgtgaaggtaaagtacacttacagttcttcatgtaagtcaaaactggggtcagatcagcctaatttctgcacaatgttcaggaagactatcgtcttgaatttggctcatgagaaatcttatttctagacaaaaatttgaagcaagatttttctttttgttggaagttcaatagactagcattttgcattcagcatcctgttgattctaagactccccagcatttaaactttcagggatattttatcatccagcaattaaattttgatgaatttgtgttctttacagtctgttctcattcattgttttaattatgcctgtttgtgtttaaatctgttcatgtttaatcaaaaggatggcctcgtttcatttcaaaagttattatcaacctcaaaattgtctaataaactgtgaagtaaaacaaatttgtcatttttcatatttatggaaaagacatgatttagcaatagtattaaaggcagaaactttaaaaaaaaaaccatgtgcagaatatgacatttgcttaatgctttccttctactggcaatgtttttcaggagataacagcacagaccatccagaaggaacttaaagtaatttaaagtgatacctgtgaccctctaagtgcctcctgctatggtatttctgcttctgctttgccagggggattcatacacagaaatctgaattaaatgagagaaattaggcacccattaaatttgcttttcagagagaataacagcaccataaaaagtgctgtcacagaaaaaaatgacatagcctattctgtattgatatgatgatatagattaactcctttgagcatgttgcatttgttattttgacaacttttctaactatgctatagaatttaatttgtaaaaagatgtgaatttcagatactcccaacccccatgctgacatttttggttctaacaggtgaatttctcaatttctgcctttgtgagttcttgccttcaaagtgacttcattattctttattttgattagtcaagctgtcaagatcccaaattaaaacaaaaatggattcagaattctagcatcatgcccaccatctcaacactgtattatggacttttttttttctccaactttacctggcatttgtattgtcctggccttcccaattctgctggtaagcactaaaaccatagctccagatgagaaaatgcatgcctcactgaggtatgcctgtctccccgtgagaatactacctagatcatgatctgagttcttgtgcagataacttttatggcaagtccgtattaaatcccctggtgcaagaacaaaagaagaatagaagaatatagaatggagaagcttgctcaaactccagagagtagggaaaaaaaggtattaaaaagtaacacaataaaacaagcacattggcatatgaatttgcaaacagtaattttcctacctgtggctgcagagctgcactgtcctatcacattcattacatgcccatgggacttttgtcctgtgttcacagttggctgatagcagtataaagaaggatggaggacagactcactcacttagcgtctaggagtcaggtgggctcgttcctgctcttcctttctgtaacctgcaaccttgtatgattctcacagaactggtattgggttcaccacgtataaaatgggagattggtcccatactctttccttgccatgttgacttggaatgaataatggcaacggggtggctacttgacagagttagaacctcttcaactcaggtgcttctcatagatgccaggcactggaattctgatgttgttatatattcctgacctaatggatgctgggctatctcctgctctccttaactccttatgcctcttaaatttacttgatcatcccagggttcccacatttgaatttactaatctggtaaacattttttatgctaaagcccggaaggtcattgaaggttcttctgctgctgtctccgatagccctacactgaacaaagtgcattttaattgctcttctctagataatatacctgcctttgtagtctaatttatcaggaatgctagtttaactcagagtcggggtaagtattactcgctgttatcatgggagacttttggggctgttatgaggagtgggaaaaaaaacagtcagctactgtctaactccacatatagaattaatgatacactttgggaggctgaggcgggcagatcatgaggtcaggagtttgagaccagtctggccaacatggtgaaaccccatctctactaaagatacaaaaaattagccaggtgtggtcgtgggcacctgtaatctcagctactcgggaggctgaggcaggagaaatgcttgaatccgggaggcggaggttgcagtgagccaaaatcgcgccattgcactccagcctgggcgacagggtgagactccatctcaaaagaaaaaaagaattaatcttgatagtcatactcagtgtataaaaccatgaccacagtttgttttgaaaaacagactctaaaagagagtacatgctttccttgtgtgcatcaaaagcttgctcactattgttaaaaccaaaaatagacttggtgtgattaccagttattttattttcattattttgagatctaaaacattgtttctaaatatctacttgtgtaagtaccaagcgattggtaagagttctcaaaaagttccctttcctcagattcttgaaatctctcctttccaagagaggtctaaaaaacatacaggtttaagatttccatctaatagttttaatttaaacatgtctggagtgggaaggtgtcacacaaagtaaatcagattaacttggagtaacttgtgttgttatacagaacagggttgattctcaaaagcatccttgtactaggatggtttagaatgaactgtggagcatgtcttgtcttcagttatggaccagggacaggatatgtgggcgttatatggcatggctttggtggattatatggcatgtgttgagaccttctggatttcatgcaaaatacacttcgtgtagatacagagtcttgttgaggagcaggcacagagatctgccctatgtttatagcactaagtgactgttcatgggctgcccaatatattttagaggtatttggcacaactcatatttttattagtttttggaagaaactggctttccctttgttatctttccaatgccaagtttgaattgaaaatgaacattacatcagcttgtttcttggtcattgggaaaaaatcccgtctgtacagacaaattcaacctgagtaccaagggaagaagagacatatgatgtctgttgaaaattgtcgtatcaagttttacacattttgtttagaatacagtattgtccctatccaaatcttggacacacacacacacttaaattttaagttaaaatctgctctacatacacaagaataaagatttttgtaagcatatccttgtactgtttgcaaaatttaattattctgtgataatcagctaactagtcatgtttatagtgactgaggaaatctcacaaggaaagcactaaagcagggtctggaaggtggatttacatggatcccttattacacctattcccatgattgcacattaactaattttgtattacatatttgtttcagtaaaatataaagaaattattatttaattggctcagagatttaaaaagtactgaataaggttacattcttagtagtgtaagataaccaagaagacgatgttcagatcttctgtgacataaattaccattgttttgctttcccacaacgtgaacattttttaaatgctggtttgagaaccaccatcacaacaaaggatgttaatgtgttaggttttttcttttaatataaaacagacctacttgcatatttttttctagtttagcagttattatgcatctactgacttggttagctactgaaatcaagaatcctttaaaccaagagaaaaggagaaaatactaaaaacaaaacaataaattaaagagctctggggtgtgtttggattattttcttgtcatgattcttgggtgtggtgacacttgttggcttttctatgtggttttattaaggactttgtgtacatttccatgttgttcagcttatggcgtcttgcctttgttgtacccggagttcattgtgcatgtaggatgaactttctcacagtcatgcctatgtaaagtgccaaccaaatggcttggctgcttcttctatatctgctgtacctacatactctcaattacagtactaggcaagagcataggcaatggaaagttgtctttataggattttccttgggatgagttttgtagcagaataaatagcagataaaatagtgcacatcatacttgggcaatgtaattactgtttatttgtgaagataattaaaaaaccaaacatttgctcaaggtttgaaaaacatttgagagtgaattgaggcagtcagttactttctgtccctgaggtaagatcactgagcttaggttaagatacctcacaagctgatttggtcttctttcctcggcttcacttatgtggctatagcttcaggaatctgagattgtcagaataattagttgtgggtttgtttgcttctttgttttctgaaagtaattttagaccagatggctagtcataaatttattcactcattcaagaactagtcatttagcatctatgtgggtcagttctgtgctgaacaattgatatacaatggtgcacgatcttccttgtcttcaaaaaggatgtagtctagtggggaacatagaccactatatacacaattgtaattcagcgtgctaaggattaagtataggggccaggtagtgttaaattgggtgcacctgacctatttgggtatattgagagaggttgcccagaagaaatcatagtaaaactgagacaaatgctagtaattaacaagcaaaagaggtaaaataaaaagaagaaaatacggagtattcaaagcagagggctcacttttgcaaaaagtcagagttagtagttaagattcaaagtctgccatgctgtcctggtgaagttctaataacaaacatacacttccttcccagttttccttattgcatggctcagaatgaactcttatttcatactcattcttactatatagcattgcctttggttatcacaaatagtcaccaggcttttccctgaaagtaaatgggtttcattaggagcagatgtaattctaatctgtagagtctgtaaaacattcaagggattatttggattaaagaactctaagttttaaggggaaaaatattatcattattttaataatactttcccaagtcgcaaacgaataactggctccaacaatcacatcactgtaattgttcacacatttcaggcaggcattttacagccacacaaagaaacttcaacagctaagctcctctgatttgattgctagagagactcaaaatttctgttttagtgccaaaaatcgaatcactagagcaaaagttagacaggaaaggctgaacttgaacaaaagttcagtggttttataaagtgtgctattattgaatctcatcaaatttaagatgtattagttgtaatgtgcactattttatgtaacattaacaataaatacataacacactgccatttaaactatgacatgctatcagctgtaagaccttctcctgtttaatttcagagagattaacatgtgaaatgatgtctatcttagaatctgtgaatcatggctaacaacaataaatatttctatgaagtctaatgggtatttcttctatatgataaaaaaatcaaaatgaaaaatagaaaatcaagtcagacatttgaaggctttgtgtttgagattggaagtgttggaaggaacatgatagaaaatagaaaattagaccttaaaataggcattccagtctcttgagcacattaaaaatccctattacttaagggagatttgctatgcactgaatctgaaaaacagaaggggtaggaaaacataaagatattgtcagcttcctcttacctccatcaaacagaatcatagtgtcattaaattaaattcttttgatcttcagcactttttgaaagatttttgtgctctatggttgtaaatgtatacacataaaactaatagttatggtagagtgactataggaaaagaaataattagtgagaaactttgggaaaatggtggaagaataaccaaaagatagaaaatgtgaataacttttacttatctgttactggctattgagcaatagatgaagatgagctgagta

SEQ ID NO: 1070 - DNA, 4146 bp, Homo sapiens
acccagtgtaaattcttactatcctctaacctactttctagcaatttctatcaaaatgcagagtcgtcaaacttttccaaggcaaaacaacccacacattcattatttaagcatttctaacaaaggtgagtaccaattttggctcactttataataggaaatagctggttgcatacctcaaagttcaaaaggctaaaaaataccaggtttttctttagaaaagtttctctttacttagtaacacgtttccctttgattttcacagtaggctgttctgtgtgggaatgttggagaggaaacctcaacgttgagaaattcaggctgtgggtctgggctgccgattgagattcgtatcacaggaagcaaactgaaacaatagctttatgatattagctgccacgctgggctgaggacagaacacactcttacaggaacatcggtggaaatgccacttgattgtcctaaatcctctttcaagatgagccccacaaaccatgagcgaatcagggtcaactctgcattctgagggcattaaaccgcagtgaatatacaaaatttgcttttcattgtaaaactgaattttgggcttgcccaaactcatacatggcgaaatcaaattcattttccatggacctggagatcagcgtgaagcaaggtttctaaagagaagtgtcagttgcattatggattcatcatcatttgcttagcgaagacatcagttataacaagagattatattttcctgatctctagactactaagggaaggatattaaaatgtgagacaagtgattttaaagtttttaaggcttgatatgacctttccatgcaggaaaagtgggacaaagaaagaattgtggaggcagatatatgttctggtaccctctcacaccccactttcagacttcttttcccaggctttcactcctacctccacccctttgtcccacccactccaaatcaaggcctttttctgtcctgtttggaaagaactcaataagctgattcatgtgaggatgttaatgggtgagaacagctaatatacagtctcttctagagatactgactttgttcagatcattcctttaacttaaactaaaaagtctcgtcagtcaacaggtgtttgctgaacccagtcctgtactacatcaagggtaatacagagaggcaagataggatagtaagatacatgcaaagaacaaaggcatgaatctctcctagtggactttcaggactctcagggagcccaggaagatcaggaaggacacagtgccttctgtcaaaggcatcagaggagcccaggcctgctaatggtggcatttaaaggtatggctaaggatccagtaagcgatcccagagtgatttccctgtggcttgactggcactgctcttgcagtctgcacatccgggagggcggggtttgaggggccaggctgtgggtcaggtggaggggaggaatcagtttaggcagagccttagaaggaaggcccctgtggtggtcacaaagtggtaactgccaagcacatctgaaccaggaagaccccatcagaatggctttaagaacagtcagagcagtcctggaacttctcggagtaggaaacaagaggcaaagcgaccttggtggaataaaagtgcagccagcattctgaccagcagcaccgtggggcagcctggtctctgagaccactcaggagcctctgctctgccactctgcctgctctctcccaatgcacagcccctgctgcccaggaagtcccaccccacatgggcggtgctgcctgaaggaaatgagcgttgctccggaaaaagtgctccaaaacctcagcccgcgcatatcctggctgtggggagtcatcaaagcctgtttaccggggctatttttagcattaaagaatcttgttatgctccccaggacgggcatgcactttctcagcagagcacctctggttttaatgagccatctctcgtctttggggtcagaccctgaagggtcctcggaagcaagtaactgagatctggagcccaggatgatttacagacccacttggtggcttattgagcacctactctgggctcctcactttgttctgaccaagagttgatgctggattgtggcatcaccttacagcagtttatctgtcttccccaccagtctgtcgattccgagggaaggaactgcccttacacctttcagtatccctgattctccttaagacaggactgagcacacagtaagtgacacttctggacagattaccttgtgcctagcataaagcagacatgaacacagtagaaacttaataatggtgtagggagcgcgtgcattttcccatgtccgtaacactgagtaggatattaatggtacgtcagggaagacacgatgttcataggggaagaggcagaagggtcttcagcagatttgtgacatgagcctccacggtgaggggctacctcctggctccccagttttcactctcagctccaagctgggagtgacctggccaggttccttcagaagctcccaggagaacaagcaggtgctgtgagggcaactagttccacagagggaagagaccctgtcccggccctgccgtcacagggtccctggggccaacctgctggcttcctggtcctccagccattgtgaccgcagtcccaagacattctgttacccttcgtggccctagattgcccctctccctcccggaggccagctgacccgatgctgctgtagccgatttcgccacctcctggaagcaaatgcactgggcatgggtggaaaccagtttggctgtgttggaactgttaaaaacaggaaattttaagcaggactatttcctctgggactagttaacccaaatagggttgtcttgggattacttcagattttgaagtcagcgttaccactgagatcaaagaaattgaagagaaaatatcttctcggttggctagaaaccacagggttggcctctgtgtatctacagaaggtggtcacctatctggtgtgattgaagtggcgctgaaaacctctcctcactcatctccaaaataagtcaccacctgccagcacagggtaattaaggtcactcgtaggatctttgagttgaggccatagctctcagcatgtggtcctatgagtagcagggtcagcgtcacctgggaactttttagaaaaacagattctcagttctactgaaccaggaacccagcaggggcccgtccagggccagcttcatgggcgtgcagcacaggcagtcttagagggcgccacacttagaaagttctcaggcttggtttaatttttccaatgagaggtctcacatttttattttgcactgggccacgcaaattatgtagcagtgctggtctcagaaatgtttctttcagcctggcctatagatgattctgatgcatactcaaatttgaaagcactgagttaagtcattttctcccctaaagcccctgttcaaatgaagattttagctgggaaagctaacattcacagtggcatcgcccacacctgggacattgcatcatcgcttcagcgggctgatgagctggcagagaacaggtgtatcagcagaaaccccaagcagggatcaggtgtgcgtatgtgtatggtgtaaggtcattcccatgacctgtggttctcccctctccaggctagccgcctgaaccagggtgtgcagaggaaagaatttcccttgtttcaccattttagcagaacagagggaaagccaccggggcattactctgtacaacccaactcttggctctgaagccttgcccatccccggacaggacccactgtgatcctctgcaaaaggcatctgtgactctggcgtgttctctgatcctgtgtcctgaaagatagctggtcccctttgccttcactgaagcctcttggtaggaagatcttgtaatgtggatttgttcttcttgaggaataacagcaggtaacccaaagcttaaatttagaggctccaggaaaaagataaaagagaaacccagttcccttgcagaaaggcccttgaacgacatttcacagcattgatgtgtccctggccaagtggcccataaattgaattgcattctacattccttagaatagtctccatttggaagactccttttagttcagtgaatg

SEQ ID NO: 1071 - DNA, 1833 bp, Homo sapiens
ttggatcatgatggggtattaaacttgtttctcaaatctccacatttagtcaactcctaggaatcccattcattcctcccattgctgagaatccagatttaaacagaacagggaacaaccccatggaagtatctttgtattagaaattgcaggaccgtagcagagagaatttccaaagaaaccaacccacttaaggaactccattaaactacgtatgagaaatgcagggtcctacagcaaacgactgcttctagcaatgcatgttgagtattaacaaattaaaagcagactagactttaattgactatatcaaggctaaaaaacaaagattaaattaaattataaaagactaaattaaattattttcggaagacgcctatttagattcaaattttcaaatggccattgtacaattgcctcatcccatctactagagtttatgctaggacaagaagtggcttttattcaccatgtaatctgacccctatgccatttggctaaatgtcttgcatggtttagtccctcagtaaaaataaattgagtttaatttaattatcaatctaagatttgtataaatattttctcttataaatgtataaaaaattataagacttttataaatattttttcactggtgattttaaaacgaagcctctgagaggatggtataaatgcttgtagaatattcattaattttttcttatagtacttttagttgcttatactcttatactttgactaaagtttctttttaattactttttatttataactgacatataataattgtgcatatttatgggatacagtgtgatgtttcaatgcatgtgtacattgtataatgatcaaatcagggtaattaccatatccataactttaaacatttatcatttctttttggtgacaacatttaaaattttccatcttaaatacactacattgttatttgctatagtcaccctactgtataatagaacaccctactgtataatagaatagaacaatactttgtctatatgtttttccaatatgccaaatttcaataaaatgtgtttttaaattgtagttactatgctcctgggaaatcttttttttttttttttttttttgagatggagtctcgcactgtcacccgggctggagtgcaatggtgtgatctcaactcactgcaacctccacctccagcttcaagcaattttcctgcctcagcctcccgagtagctaggattacaggtgcctgccaccacacctggctaattttttgtatctttagtagagatggagtttcactatgttggccaggctggtctcaaactcctgacctcatgatccacccacctcagcctcccaaagtgctgagccatcgcacatgagccaccacgcccggcccctcctaggaattcttatggtggccatcttgcccaagatgacagaaacactagtcagtttcaccacaaatcttggtcagcatgaggagagtactaaacttggtcagatgcgtcaactttgggagttagtgaggaaacaggtaaacagagctgaaacagagacttcacttcattgggcaggttaacagcatttcctctgctctgcttttgcagaagttaatgaatatgtggcctcatcttcttctgagtcatcctaacccaaagcaaaccttatgtcaacacttggtgtaaggtgatccaatttgataaaattactatttatctctaatcctttaaggttcttcaggtaagtttgcttccataatcaaattaatataaaagacccactagtgaaagcttaatggagctctaatttcaatcattttgtgtactcataaaatattcc

SEQ ID NO: 1072 - DNA, 30179 bp, Homo sapiens
aatgcactcaggaattttacatcattttgaatcttcagaattacagaagggtagcatgcctttgtagagaagggtggtttttatttcaggtaacattctatcagcattaccactgacaggttagtattgcctgcactttatctagattaagccttaacataactctttcatcaaagctactacactgacatgtaggtgactgattctaatggaattagatgaaaagaagacaaagaaagggctgtcgtgcccacaccaagagctttgccacccaacatgtaccattatttcctttaaagctttcaaatttgactttgaacaggtttcaccaaatacaacactgaagcaattgctattactgatcatgccagagggattagtagaattttctcctgaattatttctttccaaagggggagtttgtagattaaatgagtcttggaaacgtttgctgaaatgtatagattcattttatgactagctttctagtcactgtcttgtgggttattaaccctataaaatgaatattttgattaactgtcctcatttttaaaacatttgacatgaattgttcttggaaattttagtgacagcactcaatatgatttcctcagttatttattcaacagaaagttgtctattatgtaaaaagcattgcagtgtagataaaaattaagcaagtcaaagcattgactaagtaattacattgtgtttggagacatgttagcagtttgactctgctaaagctttggctgaatatgtccaaaggcaggaaatgccactagaaagtttccagattataaagatccttgcataacatgccaaggcatttaataaacagtgagaatacctttatatatttttaacagaagagtaacaaggaagatctgtatttcagaaaatcagccaagcttcagtctgtagattttaattgctttaacttttaacttcttttcaaagagaattaacacaagctaagttggtgacagcagcaatggtgaagggaggaaggagagataatagaaatagtcaagaaatataattaatgagacctagtgcctaattagatttgattgcataagaggaggagaaagtaaaaatagtaataagactgcttcagagactcccttggaattatagtgtattccagcaacaattaaatcctaaaaagacccagagtacttttcattcaattcctatgctgtccaatttctgggactgacagctgtcaaaattttggctcctttaaccatatcccgtattcttgtagtcttagatctttggcccagatatatgactataaattatatatcctctcatattgttcctgttcccatattttctggacttcctctttccaagtccaacttccttcagttccctttcctcctaaaatttcccactgtgctctctcagaactatattcctcagttaacaaatttgaccatataatcattgctgaatatttcaattaaattttggctgttcctgagaacaaattatcttactgctaccctctcaatttaagggaaatttcctccacattcctcagtcattaggactgtgacatgaggatggcattccacatactctactcataattatccagaccatttccctctgatattatccaaaatacccttgctctttggtacttaaacttagtcacacacacctttttattcctttctacatcatctaccaacatcttcatcagtctttccctggcctcccattctttgcttctgcttctcagtttctcatcaaagataatggaaaaatctacttggattatccctctgacaaattggcatcccagtcccttaacttaaactctagtgacattttcatctattctattttagccactcaattctaaaacaaaaaataatgaccttattcttctctagaactgctcaacctctacaaactcctacatctgttatttgactcagttctcaattttcttagcaagttactcttttaagtgttttgacttcattgactccttaaaatatctccattagagtgtcgatttcttagtttttctttaatagcacctattctattgaaatattttctattatgggtttaaatgatcttgggaaatgttaactcaactaataggcctctgtgattacgtaatctacaccactattaaaataattataacaacttggatcatacaatgtcttgatgtaaacgatacattaggtcatgttatggaaatgtttactagccattgaatattttaatcttatttagaatctctaatcaaatctatagagtttaattatttcccagatttttctatttctatacttacctaccactgacattattcttatctctgaattttaacctaagttatttgacaaggtagttaattattgcctactcagtcatagaaatcaaaattcaaacataaaaagatatttgttgtaagttttactgttcttgagatcagagaagctattacaattaatagcataaaaattactagaaaagtagaatttttagataaaagaaaaatttagttctctaaactagtctgggttagaaaaatgcatgaaaattatatagtcatgtaatttcttaaaatattatatctattttgagcaaaatatctgaaagttttctttaagaattcctttttgtttctattataaattatttaggaaaaggttatatttttatgacaggttttttccccccatattataactttaacatgttttctttgatataaaaatataaatcaagtaccattatatttatatgtcattaaggtactgttcttgagcctatatcatgtatagcgtattgtgcattattttttctggcaaccataatctagaaatgggctatagaatgaaattcattaatgctatgttatactagaaggcacagaacataaagtaaataaatcttttgtaatatcataccaaccttataaattgctttaagggaataacaatctataggggtggtagatgattttctaatcagatattacacaatatacatcaaatattctcattctgtagtatttaaaataagcagttgtctacaacatacaatcaccagtcacaataaactattcatgcttttgtagacccccaatttgataactgcataaaacaaccaaatattttagaagaagaaatattataaggaatgtatatccaagcttctgtggttcgaccaggagctattgcctgaactacacctccttagttggactgaacaattatggaatgtgtcaaaataggcctaataatttatctcaaaaattaattaataatcaatgataaagctaaagagttttaaaattaatgcccagtaacattcttttacaatgtgaaacaaatgtaattcttatgtcatagtcatattcttagatgccatgtcttggctcactagtgttttaggccctttgcaaagaaatatgtttgtgttgataacagaaagtcaacatttgtagataatttcctttttaaaattagttgactaaacttgtcttagtttagttcaaatatgctttatttggtggcagagaaaaaggacagggtttaaaaacaaggaaattattcataacctgggtatctctaaatgaaagtattgtaatttcaaagacatatgtttcaaaattttattccagttaaaataaaactgtattatggtaagtcctatttaaaattgtaattttatttcagcacaaaagatatacacccatagataatgcaacactttctgcctttatgaatttgcactgcggaatcatttctaatagaaacaattccaaactattccaaaaatgcaagttctatgaagcattctgagtcccaaccaagcatgcaaccaacaaacttttagcattgcactgagagggtttttttaaatattgctatttttttgtttgtatttttaatagtgagaacatgccacaatattcctggaaaaattctgagcttcccttcttatcttgctcttttgggatctgtcttttatgttggaaatctgtctaaaacaacacataatttttgcccctctattcaagtttaagtataacagattaagaagccaattggaagaactctacatctgggcacaatgcattaattattgagatccattatagatagcttgtatagccaatattcttattacatgtgaacttctactggccaactctgtagaccccttctggttctatcatccagtgacctggcagtgggcattctaaacgttaatgtagaaagagtgctctaggtatgtcatactacctaatacttccgttttatctcctttgtgtttgcatttaataggccaatgacattttggcttaatttttgtatctattgtcttttatatgggtcagggagggacatcttttagactgtacaaagtcaggaggcccacagaatttaaatgtttttttgagcacacgttcaaaatagctcttcgttttcagttaccagtaacctctatcaattaccaagcttttcctgagttttcccagataagtcaaattacttcccattaatatctacttccgtaggttcttaattctgacctctctcagcactgctaagtcacttaacaactctccatctactctatactcactcatattaagttttggtattgtagatatcctggttttgtcaaagacagaattgtgtttcttttccttactttgtagctttgaaagaaaaaatggtgtaaatgtcattactccactatcatgaaatttgaaacaattagaaataacagttggagagagagaagagagggatgtaagtgtcattactgcataattttgaaatgaacaattagaaatgagagtaacgaagagtcaaagttttaacttcaaggtgattgatgggacatgggaaatgagttacaatgggacgtctagaatatttcccaccactgttaatatttctgccacaatttgattttttgtgccaaaatttttctcatatttgttgctctatatgtttttaaaaatcagtacagcgttttttttgtttgttttcttttgttttttaacctcagcatttatgaaagctaactatggtctactggatgtaaaatttggagagctgggtttgagttccaaggttgttattctctggtcatgtaactttcagtttttaacttttcctttctttatctcagttccagattactggtataggaaatgtattagagagacatttttaaatgtcctctctaaaatagtgactgttttgaatactttgcatattgtttttaattcttcatgaaacctttaatgtaactgctatattctattggttttgaccaaattatctgagacataacttacccaaggccataaagctatacaattatagatgaatatactgataaccttcaaattttcaaagttgggggcacttatcttttgtttgactacttggcattgttggcaaccaccccattgaattttatggccctaattcttggccatttcttctccacactttttgtagatgtctctgatgtttatccttatatttcaatattttccaagctctttactcagcctttcgttcatcccacgttaaagatggcatttgaataaattttttattttcccttaaaaattatatttccttaaaaattctagccaagaattctctgatatgcacaagatttgtatatgtaaattccatatacctgtggatatcacgagaaattcaaaccaaatgtctctataattatatttattatattttcccccaaaactacctatcctgttcctggttcccaatttactatttactgacatctgaggcctcaatttttggtctcattcatctatttatattcttatatctccctaccttctatctcttctcatctacactctttttctacatctacactgatttttctaagccacaaagttttcatggtataacctacttaaaatctatgtcttgacacaaattttggtgtatattttatactctttagattatcatgtaagtcttttcattttatcttcagtaagcaataaggagttggctactgcttaactttctggtcacttcctatgattcccccagtatacttgttaatctgtctaaagatattgttttactgtctaaatgtttcctgatccatttttctgccagcatgtaagtttctttctatgtgatattgctattattcatcttttaaaattcagctcaaatgtcatccatttcaggaagatttcccttaaatctcctctctactttccatggctcttttttgatattcccataggataatgtacaagcctctctcagagcatgagcctgaatttattgcaaaattatgcatttttgccttgcccatttcctccaattttatttatagaatcttcaatgctatgtttatagattcacttatagtctcagaataattcttatcatataataaacatacagtaagaaaatttcaaagaaagaaaaacaaaaggaaagataaagcatttgattcattgtctttctattaccaaattctaaattgtttccccttcacaatgctgccttacttatctcaaagagatgttctgacactgacaaaatttatgtgaaagcattttacaaatacagaactatattcatttacaaacaactaataagaatatgtattgtgaagcaatatgtagtaacagaaaaacttgaaatacttggaagtaaaagaatagagatcaaatctcagtatcctttatttatgcctgagtatacttgccaacaaaattaggtcaaacattctaaaatccagatggtttctgtataaattgaaatatttttagtttccccgcctcctcacatggtccataacctcaagtaatctatgtgaaaatttggttaaatagcaaagcattctacaaatataaggtcttacttatggttaactattaaacatctgaaacaggcaaaccattgcaaggaatacacagttacagaaaaaagtagtgtgttttaatggaaagagcatggactttggagtctggcaaactaaattctacttcagccagttaccaagtgtatttgactacaacacttggtctttaatctcagtttctccatgtataaatggagataacaccagttctgtccatttctcaggattctatgagacaagtgacataatccatgggtcagcttttgaaagcaatgattctgaatgcagataaaataaaatattgttattttcttgagcttgaaatacaagaaataattagaatgcgtgagatagagaggaaaatcctcggtaacactacctgacaatgagcagttctaagtttttattttattttgggaaggtaattctcaattcacatcagtcatcagctttaggcctgtgactgtaagtctacattttgatattttaatattagacacatatagtacattacatacaacaaaaagaatataatgttataaatttccatttttcaattaactaattctgattaccactttatggctattttattttattttatttttttggctactttaaaactattacataaatatatttccatgtcctgatagtttttcttatattattaagaaaaacagtcctgataatcctgataatttttcttatattattctcattggtgtttaggtgctctgtgccctaaaactaaaaattaaaatgagacatttctttttgaggacaagccaggacttgaaaatgttttgttttgtgacaatctccatcatccttggcctatccagtgaaaatcacacgtgacttctcttgtcactgcaacaaggcctcctgttctgtttgtgtgtgtgtgtgtgtgtgtgtgtctgtgtgttcccaaccaaacacatatttttcatgctcttgtttttttccaaaatacattcatgttatcagaaatctaatcccttcagtactaaattgccaaaatttaggggtcaggagtctgtgtcactgcagaaataatttgtggttctaaagttctcatagccatgtcccaaatctgattttcaaaatctctttatgcacctcttgagttctccattattttagagctttttcaaatgtttatttactttttaggtaactttaactacttttattctctcctatgtattttaaaattcattttcataacagatacaaaactttagttttgaaaacacagttcgtaaggtttaagaaaatttccatccaacataacatgttgtaactataaaagagagttaaaatagagctgaattaccattttttcaaagattaaagactctagaatgaaattaaacactgcattaaaattgtccatatgtttcttacatgaaatatgttaaaatttaattttcttgttttacaattctaaaattggaaatgtctttgtcactcttaaagaaggacattctgggccagtgtactagatcaatggtgaggggacgagcgggtgggtaaagaagtgagtgtaaaaggcatgtctttattgacaaagaaggattgccaatatagttattctacttcaggtatgtagagcaaggataaagcatatgggccaaagctcatccgattcctgcttttatattatccatgaattaaaaattatttttacatttttttaactattgaagaaaaattgaaaagtagaataatatttctgacacatgaaagctatataaagttcaaatgacatggtccacaaattttcattgaaacccagccaggctcatttgtttatgcattgtccatgacagttttcacactataatggcaaatttgaatagttgtggtagataccagatggctccaaagcttaaggtatcaattagctggcactctgcacaagtttgcctggttcttatcagatgcatccctgagactaaaacaagtgttttctccatttccccatattattataatacagacagcagcccctcctgactctagcttaatcatacatgagcagataactgaggaaaaatgaatattacaatattaactgaaataattgtgagttgtttttaaaaaagattctcaggggaaaaagtatacatttatacatttgtaaactgcatatttgcaagactacaatcatttaaatatgttaactttgttttatggcttggagtatgatatatttcggcaaatgttcacatgcacttggaaatcatgcgtatgttatataaattaatttaggtcaagttatttaaatgtgttgttccggccttctgtatttttaatgattttcaggtctattgatctattgattgctaagagaagactgcttaattctacgattatacttttactgcatttgttatttttttcctttcagtttcattactgtacactttccttttcttactatatgctttccattttctctgcttctttttttatcacctctcttgacttctgatttatgaaatattgttttatcattacacatttatgtgaatgtagacagatctagatctatctatctttattatcttgaaacatatatactatttacactgttttagaaaatctgtattagatctctagggctgtcataacaaaacattacaaactgggtggctaagcaacagaaatcaattgcctcatagttccagagaccaaggtgccagcgatgttggttacttcggagtgctgtgaaaaagagtcggtttcacggttctcctagcttctggtgatttgctggcaatattcatcactcattgaattctcgatgtacaaccccagtctctgccttcatcttcataatgtgttctgtcttgtgtgcttgtatctgtgttccccttcttataaggacaccactcatttcaattaggggccaccataatgatctcattttaacttaattagtgctatgaagattgtgcttccaaataaggccaaattcttaggcaatggggtttaggaattgaacatataactttaggggtacacggttaaacctataacagtagctatcctagtatacacaaaacaaaatgcttggcaaataaattctaacattaattggtactttttttttctaacacagttcatgcaagtatgtcaaaataccataactccattaagctaactcttgacaaatgatgtttttgtaaatgtttatctatattttaaatctcacaggggttattttttatcccttagctttgcatatatttaagttttctttgttttttttttttaatttatttgcacatcttcaagctttcatctcaaattatctcctgtttgctcaaacaatatactttaaattttattttagagtgtgtctacttgtaataaattcagaaaatatatcatatggttatccttgaaagatatttttcttaaaacagaatcctatttttcagaaatcttctgtgacatattcaaaatattttatcatcttatgaattccatttcttcatatgaaaaattagttgcatttcttacttttattcattaacagttcactttttctctttttaccctttggcttcttgtgagattttatttccaagacctaccaaaagaaaatcctcagctacattatacttaatggtgaaagactgaagttctccccagaaagattaggaacagaccacaacattgtactgaatattttttccagggatattagggaaaaaaaagtaagacaacttatttggaaagggacattaaaactatctctatggcatatgacacaattttccatatagaaaattctaaggaatagacacacacacattcacacacaaacttagaaccaagagtgggtttagcaggttcacaggatgaataatcaatacatgaaaatcaataatatttctgtacacatgcaataaacaatccctaaatgaaatcaagtcccattagcaacatcttcaaaaataataaaggctaatatttataatggtaaaataaatataatcaaaagtaatataagagctatatactgtaaactacaaacttcactgaaaaaagttaaagaagatctaaacaaatggaatgatgtcccgtgttcatgaattggaaaattcattattaaggtggcaaaaattcccaaattattctatagtctcaaagtaagccctactgaaatccaagctgattttttttagacattaacaagctgatttgaaaatgtttgcagctatgacagagtcacaaaatcgtccaaataatcttgaaatagatgatcaaatttggaagacttgcactttgtatttttaaaacttaccacaagaaacactaataaagacaatctttactaacataaatgtagttataaaagatccatgatggaattgtgaatccagttatatttcctcacatttatggtcaagtaatttttaacaaggatgctaagatgattcaataagcatagaatatccttttggtattattttgtttatccacatacaaaatactaaagttggacccttatctcacattatacaaaacaaattactacaaatggaccaaatagttaaatataagagctaaacctataaaacttttagaagcaaatctatgaatacaccttcatgaccttggattaagcaatagttttttacatataacaaaatcataagtgacaaaaaatattaacatattttatgtttcaaaggacaccatcagaaaagtgtaaagacaacccatagaatggtagaaaatatttccaaattatatcttataaggaaccactaattcagtatatagaatgaactcataagataacaataaaaaggcaactgtctcaattaaaagtggacaaggaatttgaagatacagttcttccaaagaaatacataatataaacagtcaataagttcaaaaatatatgatcactatcattagctgttagagaaaatgcaaaacaaaaccataacgaaataccccttcacacccactaggatgacaacaattaaaaaaagatgtaacaactgttggtaaaatgtggagaaatggaaccttgcatataccattggtgggaaggtaaaatggtaatgcactttggaacacactttggcagtccttcacaatgtttaacatagaggtatcatacagcatagcaattttatcctaagaaaaatgacaacatatacccacacaaaaatatgtacatgtatgatgatagcccaaatgtatcaactgatgaatgaataaacaaatgtggtagatgcatacaagggaatatatccaacagttattttaaaagatgaatggattgtggatataggctacaacattaattaaccttgaaagtattatgttctggaattaaatagtggcaaggattgcacaactttgtgagttttctataaatgggtatattgtacacttttaaaaagtgaatttttatggtatgtgaattatgtctaaaaatacttttaaattaaagatcactttctctttggttttctgcaattttgctatgaaatgcccaggggactatataggtacatggatacacagatatatagatggattaaaagatagaaggataggaataaagatagataatttcaatcttgctcctgccttatagaacttctggaaactgacttgagagtacctgtttggggcaactattgattattatatctccgaatattgcttctgtgacattctttatcactgtgtcttttgggattccaagtgcctgtattttataccttcttcttttatgctctaacttgatctattttatatattttccaactgttcagttgcttgaggttcatttggtataattatcaattcccataccttcctttttagctgtgtttttttggtgttatgtttctatattttgtttgtgatttgtttattgctttgtttcgattttagaattttcacttgatatttttacagcttgtcaatcttaccatttcttcttgaacagagagaacagttattttaaagtctacctcaaatgcttgcagcccttggggactgctgtattctctatttttttctactagtttttgttcaaattgtcctttttccttaaatctatggttatttctcaatctgttagtgacatgacattttttaagttgctgatggaaagcatgtgaggcagggaatgaaattatcttttcttatataaaaagtaaatatttttacatttggcaggcctggaagttcagtagcagtccagtaccaccaaaatctaattgcaaaaaataagatggcttgaaatggtcctgtagttcatgagtcttagtcgatttagggctgccataacagaataccataagctggtggcttacaaataatagaaatttatttctatttcattctggaaattgagacttccaagatcaaggcaccagcagactcaaggtgtggtataggcctccttcctatctcttcactgtctcttccctgtaacatcaaatgacagaagaggcaagctatctctcttgggtctgttttgtaaggacactaatcctattcatgagggctacactctcatgacctaatattgccttaaaggctccacccaccctccaataccatcatcttgggggttaggatttcaacacagaaatgtagagggtacacaaacattcaggtcatagtaccatgtaaggatatatttatgttcaagtcattcttccttttaaattgtggccactttgaggttttcaacttctttcaagacgggattttactaggcaaactttttaaaattttgtaccagatagaaaatatcccctctcttcctcaattttttaaagctattgagtttttaatctcacaagcaactttttcaaaattggccaaagagatcatggctgatatctctggatatccatcttcttacattgctttggtgaaaattacaaccattttacctttaccatgttttaagacatatcaaaacaattgttcagcatttttaattgttctaagcaggaaaagtgatctatgagaaatcattccctattcctgaacatttactttatgtactaatgtacttgtattgttatgtgactgagtccaagaagaaaggtttttgggataattcatatatatgttttcaattattttccataatgaatctgttttcatgtagagaaaaatgtattctattatttttaactagttgattatctttcatgaaattagattggaaaaggccaagagctgagttggtgcactatattagtaccacagggaatacccaatgtccacataaatcacacctaagctgtacataattgtgcaagataacacaagcaaatatgataatttgtggcattgataaatagtttgcataaatatttaattgctatatctaaaatgtttaaaaataaaaatacaaatatatgtattacgttctatttttaaatgtttacattttaattagagatatcagaaaacacagtataacctctaatttccttggatattccattttccagataaagccaaaataaatcagccaatacaacacatgctttttcaattatggtactttttacaagagttaaaacaattatttaaatgtaaaaaattaaacataagactgtgtggaaacttttaaaggcaaaatttttttttgggtgagagcaagtctatatatactgacttctacctaactacagtatccaaacttatgctaaataaattattttacattctataatgatcctcaaattttgagtgcacttacactcttctttctaatatatgtaagtcttttaaggatgttttactaaattgttacactaaacagttggaacaacttcctttggtactatacacattgagaagagattcaatgaaacacactaagctctagcactgaaaacaaaaattttaatgtgtattgccttgaattgtatgcaataaaacagaagagaataagcacagattattgtagtgcaatcttctaaaaatgggaaacttactttcacctgcaagaactatttttgtgataaggtaatgatggtgctataaaataattatagggacactttcctgagtgagtcaatttagagaacagctaaataagtcaattaccaaagaaccccatggtgaagatgttggatttttacaggttttagaacacacatacacacatacaaatacagatgcacacacgcgcgcgtgcacgcacacacacacacacacagagagaggagagaaagaaagaacccattgaatgatagaaaagaacatccctgaaatgaaaggtacatggagttttttgtcatatagaaaaaagaggttgattttaaaatgaactgacatttttgaggcgaatatattatactataaaccattttcttgaccacaaaaagacgtactaaagtgggaatgaaaatgaaagcatggccaaatgatctagctctgttgacatcctatgagtctaagtggtgatctaaatttcaaagaatttattacaatttctggaaataggccagttttctgccaacttaaaaggtcagaaaataactactaaacttattggtacaaggtttccaaaatgtctaagccaaaaatggtttcaatagcataaatactaaaagtagcttatttcatcttatttaaatattattaaaatacttgaaacctgaggaagcacagttacattttaatacatcagccaaatactatggcattaagaattgaattactactaaggatcaaggaaatagaaatcaatgacatctaagatgaaaaattaacaacaaaaatcatcataaattttctcacttatttttaaagttatttagaaatctttgaatatccaataacaaaaatgagaaatttgtaagacacaataagattctccaaatgataacagttttcaccacatttttctcaataattttatattttaagtggcaactctctcccttgacttatgaaaccgtcaactactttctctcctccaggcaactccaacagacaatgaataatttactcataattctaattaaaaactgaatagaagctgcacagcctgtgtaagttataaggcagtgtactaattatctgttacttgaattttaaatagttataggcagctttaggaaagcatgtatagaattagcaatccaaaccaaaccagtttcctgaaaacactgttgagatattactgatttcctaattattgggtcttacatgccttctaattacccttacaatttatatcctttctttttccatgaaaatacataaactatagtcatctactatgaacaggtaacacattaaataatccccatgatatccatgcaagacaatgattcttgtattaattgctgatcttcttcagaggctaaacctttacttaacttttcaatgcttacatttcaacttttatgtcacaaagtccagtatgctattcatacttatgaagttaaacagaaacaaagaatttcaaatgtaagacccaaaatgccagatgcatatttgtgtatatgtggtaaaacccaacactgaagtatatttctttagttgtgcgaggtcgtttctggtgctaaaatggaactggtgatgacaacagttcacaccaagaaaaaacaatcaaaactctgccacccaccctaccaagcaaacactgctcacaggatcatttgacctcatttttatatgcattgttcattctacaggaaagataaagctggcaaattccaccagaggaaggtaaactattttttaaaatgtttcttgacactgtaattctatacatgactgaaagtatttttaaggactgagaagaaagttattcaatataatttttgttgtattttatttaattaaaaacagttgttttaacttacttttaattttaccaagtattatataccatgaatattatgagttaacagaattttattaatttagaaagtagccaatagtgccatgttaggaaaatatatgatcatggaaatttcccagaactccaaatgtttagtttaactttggcataaattttagaggaagaacaaatagtaaactgaatttaagcagggtctccctcttatagagaactgcaatactcattgaattattccttaatatcacaattaagttgataatttatttttatgaaagtttgtacttttgattaaaataatcataggataaatcagtctatgatttcatagaaggtaaactgagttacagaaaatctttgtctagccttagccttttaagtatattagtaccttggaaatcctacttgaaagtcagctgatatggaaaatatgcccatgcaaacatcatctaaatttctttctcaagtgaaattttgacaaaggggcatacatacaccaataagaatgctgacaaatagcatatgcaggttcccaaagcctatgatattggccattctgcttcctgaagagggaaagataaattcaaagaatatatttacctatttatgtttaatttattgaatatagatgctgttactgtttttcttaaatgtaaaacatgtaccaaatttatattaaaaattcattattttatatttctaatatggcaatcagctattcaagtagaaaacaggaaggaggatacagctgaacagttcataaggacataaaacagatttgtattttgttaacagtttccaattttggtccttgcaaacttgtttaggaaaaatgagagaacactttgataacatggtcttgagaggtctatattaatatcacgtcaaataatacttattgagagtatttttatgttgatcttagataagagaatagtatcttgagctctgtaattaaaacatagaagacatagtatgcttgacatgtattatcagaacatgaaggaacccagtgtggtcaagggatcaaatttgtgttgcactggtttggaaagcaatatgagccctaaagcctggaaatttaaaaaaaaaaaaacttagagccttatataagaaacatgaattttaattgaaattctctactttagaatgtacagctttatcaagaagataataaagaagagattaattagcttgtctggattctggcagcagattccatcatgttggcctaagagttgcaatggataaccttatcccatcttaaattacggtggtgctgtgatagccttacatttgttatgctataaaaaatattaaacttcagtggtttttcatgtctgtagttcttttggaacatgcttcccgaaaatgatgatggtttatagatcacgttctgtagaactgtaaaatatttagcaggagtgaatgagacagaacttcttgctacttcactgtaaatctactaacctctctaaaatatgaatcagaagaataaaatataaatcaaaatagaacgggggactcaccaagtattacaaaaaataatatgtattatcaaacaccaataaattttccctgacatctaatgttggtcttacatttattaaaaaatgtaacctttgaagtacaactttacatgaaaacctattttaaggaatcataaagagaaggcaatgatgggattatataacaatttttcatttccatatgagaatataaattattaagcttatcatttttctttttattttagtaacaaagacattactgaatgttgccaacagatttaacattggcaaatcatctgacatacagcttaatctcctatgatacaatatatgaatatatagatgtaattctgttgtatgaacaaaattgttatagcacattctggaattgattaccttgaaactaaagtaatagattagagttacttgaaatttagttgcatagtaaggctaaatcttaaataaatatgctacaattacattgacagaataaaagatttttactaaaatttcatacatagccttaagtgtatgcttgagtaatcacaacgtatatatagcttttttcttaaagataacataaggactctgacttcataaagattgaataaaatgagaaataggacacaccaacccacatgatacaaaataataaaagctacaagaaaaaaatgctataacagggacacagtttgggaaatttttaaagcaaacttcacccacaaacccaacagatggtaaatctacatctgtttacacagcttataatgaccactttcttatgtagaaaaaaggctgtgaaagagaacataattttatataaagcacactccacattacatttatatggctgtaaatatggcctagaactttccattgctcatcattgtccacaaatatttctcactcttttccattaaactaagcacaagatacatcagttgatagcactgatttctaaatacaaatttcaaaaatatttgtaatttctctgtccacctttgaaaaaggaaattgccattagactttaacattctacaaattccaaaactctttatgaccagaatagagtccccaacatttgcttaagccaatcactgatgatttatgataatttaaagtcaattgatatgtcaacagtagttggaaaaagtttgtgaataataccaagaacaaaatgtcttaaaagattttagaagataattcgatcttctaaagtttcatctgacaatgaattttaaaaccagaaaaaaatagctgacattcatgttagcaagcattttttattccacattctctatgcttgactgatccataaattgttgcaaatcatctaagtgaagcactaaatataaaaagatgagcactggaaattttcataagaaattacatttgtatgtattataatatgataatacatatcacatttaactcatattgcaactaaatattaacagaaattttggcagctgttaaaaagttcaaatattcactcatgtaaaaatatgacatctatttttttcttaaactaagattattttttgttcatggatacagatacaaataacctctctctaaagtcactccttatatagtatcattcatttcacaaaagccagcctgaacatgtcacacactgaaattcaaaaggttttaatgaaaaagtctcttttattttttgaaacagtaccattgggatatctgaaaagggtaatacagttagagagactgtgaaaatggttctatcacaaacaaaaatagtaggtcaagaaaaggaaaggatgttttaaggtaagataatatcattcattgaatttggatctactgagtttgaagcattgatagaatgttcaactggaaacagttttcagacatttggaatataatagtaaggcaagcacaggagatgtgcttaagctatagtaaaaacttttagatactataccagtcatagttaaagttacaaactatgcaggatatccaaggtaaataatgaagacagagaagcacaagaaaagattatttgagcaaagcatatcatttgagtggtatgagaaagaagagataaggaaaccttactggaataagtggtgctctcaaaaaaattaaaatgaagaaaaataaagaacaagaaaagagtgttgtttgtggtcataagtgaccagacaggaaattattcataaagcatttctcactggttttataaatgagtaacaaatatgaataaacaggtataagatcctgaagtgtaagtttatatatgaaggtgaagattttaacaagtggacttgagatcatggatcatgatgaaataatatcaataatggtgaatgacactgagtcaaaagttttgtgtgataaaatattctaatttaataaaatcaacaaacaactgactcaatgaatatacaagaaccataacctttgtagaacttactaatttacacacaaggcataggtatgcttagttagttgtgcttgttaccaaaatgccaatgagatgtttattttcccccaaatctttactgcattatcattaacaaataaaaattgcatatatttcatatatgctttgatgttttgatatatgtaatacattgtggaataattgccacaatcaagataattaacattcttcacctcacataattaagtgtgtgtttgtatgtgtgtgtgtgagagagagcacttatgatctattttcttaggacattttaaatccacaatacagaattgttaactatattctcattgctgtacattagattttcagaaattattcctcttacataactaaaactttttatcccttgaccaagatcttgccatttcctgatcctctcagcttctgggaactaaaattctactcttcatcagttgtccttgttatgcatagctaaatgtatacttaaaaccaacattgtaaagcaatgtagaagtcaggaaggagctctggtccctgtatgttgacttcccagacgaaaattagaaattgacacagaaatagcaagataatttagtgaatagtaaagattcacaacacaaaacttaggttataattttacttttatataatgacattttatttaaaaaaaactataacaatagtaaactatattgaaataataactttctatatacttttcacttaaatcaaaggccttacttgtctatatcaacttccattcttcatccacataaaatcctgggatttaagtttctccaccacttaaagtctatgtgaaaagtgaggaagtattttcaacaatccaaatttcagttccttgtctataaattagagatagtaatgtctatgcaaagattttaagaattaaatgattatataattttgcaattatttttttaaaatttgaaagcttacctaaatggtgggtaacatcatttgaaattatttgcattaagttgcagtaaaatacatgctaattataaataactagaacatgttaattttaagaaaattaaaatccttcataattgtgaaataatggaatttttaggtatatgtttttcatatgtcagttcatatcattatcatatacctttgtattctggtttttaacttagcactatgataatttaagtgttttccaaatcattacttattttaaaaagtgtcttaatgcctgtataaacataacattaatttgtgagtgtttcaattaactaagggaatttgtaatttttaacttagcattttgagtactttcagaattttttataaacaagactatattcaaaaatctttgctggcaactaatttgtctgccaagatttcattagaaaaaaatgtcaagaagtaatttagccaggttaaaaagcaatcacatttcaaagactttgatgtaaattatcaaattggccactagaaataatttgcgattattcatccatttgcaatttgaggaatagttcatggcatataccctccgaaataaaatgggcattatgttaatatctttctaatgtgttagaataaatattctattttattattatattaatttgccaattaagtgtttgtcatagcagttgagtcttttactatatttcaggattgtttgtagtttgtaaacacgtttagctatacgattatgctatatatattcttttgtatctgtctttttttagcaagtttgttctctttccaattcagtatctgtgtatgtgcatataggtacatataccctcacatatacatacataattattttaagtctgaattgcattcagagatggctttaaccagtttctctaaatggacaaatgaacaatttttttttcatgttggcaaattttatacataatctacatagatcactgtctttttttgttaatgatataattatttggagtcatttccatgaagagtaattagtgagtttaaaacatgtacctatgttacttgatgttactcattgtaaaaatgccttccagagacgttttagcaatgtatagcaccagcaacaatgcatcatgtatgagaatgattttttttctccacagatcattcccagaattagatttcagtttgttagtccctttcacttttgtggggcactaaggagttaaaataaaattgacaaataggtttagcttgcagaaacagacaaatgggtaggtgggagtgaatgttccaagaaatggggtcaactgcaaacagcttactggcaccccccgagtatcctgccacaggccctgagctcaccagctcacatgcacccaagcatcttgtctgtaagcattcagactaagcagcatgaccttataaaatttccctctagctcctgcctctttgcagacagcagagagccttctttttactatcttgcctgttgctcccttgcaacgtactgttcccttttctctaataaatctgtctttctaaacttgttactgtcttgggtaaattcctttactacccaggcgccagcctctgacagttgaccatgacaactttgtctaattttgactgaagtaaagagaatggggggtggagacaagatggacgaataggaacagcttcagacgaagaaggccattacataatggtaaagggatcaattcaacaagaagagctaactatcctaaatatatatgcacccaatacaggagcacccagattcataaagcaagtcctgagtgacctacaaagagacttagactcccacacattaatagtgggagactttaacaccccactgtcaacattagacagatcaaagagacagaaagttaacaaggatatccaggaattgaactcagctctgcaccaagcagacataatagacatctacagaactctccacccgaaatcaacagaatatacattcttctcagcaccacaccacacctattccaaaattgaccgtatagttggaagtaaagcactcctcagcaaatgtaaaagaacagaaattataacaaactgtctctcagaccacagtgcaatcaaactagaactcaggattaacaaactcactcaaaaccgctcaactacatggaaactgaacaacctgctcctgaatgactactgggtacataacaaaatgaaggcagaaataaagatgtcctttgaaaccaatgagaacaaagacacaacataccagaatctctgggacacattcaaagcaatgtgtagagggaaatttatagcactaaatgcccgcaagagaaagcaggaaagatctaaaattgacaccctaacatcacaactaaaagaactagagaagcaagagcaaacaccttcaaaagctagcagaaggcaagaaataactaagatcatagcagaactgaaggaaatagagacacaaaaaaaaacccttaaaaaaatcaatgaatccaggagctggttttttgaaaagatcaacaaaattgatagacctctagcaagactaataaagaagagagaagaatcaaatagatgtaataaaaaatgataaaggggataccaccaccaatcccacagaaatacaaactaccatcagagaatactataaacacctctgcgcaaataaactagaaaatctagaagaaatggataaattcctcgacacatacatcctctcaagactaaaccaggaagaagttgaatctctgaatagactgataacaggctctgaaattgaggcaataacagcttagcaaccaaaaaaagtccaggaccagatggattcacagccgaattctaccagaggtacaaggaggagctgttaccattccttctgaaactattccaatcattagaaaaagagggaatcctccctaactcattttatgaggccagtatcatcctgataccaaagcctggcagagacacaacataaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccgtatgattatctcaatagatgcataaaaggcctttgacaaaattcaacaaccttcatgctaaaaaatctcaataaactacgtattgatgggacgtatctcaaaataataagagctatctacgacaaacccacagccaatatcatactgaatgggcaaaaactggaagcattccctttgaaaacgggcacaagacagggctgccctctctcaccactcctattcaacatactgttggaagttctggccagggaagtcaggcaggagaaggaaataaagggtattcaattaggaaaagagaaagtcaaattgtccctgtttgcagatgacatgattgtatatctagaaaaccccatggtctcagcccaaagtctccttaagctgataaacaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaagatacaaacaagtggaagaacattctatgctcatgggtaggaagaatcaatatcgtgaaaatggccatactgaccaaggtaatttatagatacaatgccatccccatcaagctaccaatgactttcttcacagaattggaaaaaactgctttaaagttcatatggaaccaaaaaagagcctgcattgccaagtcaatcctaagccaaaagaacaaagctggaggcatcaccctacctgacttcaaactatactacaaggctacagtaaccaaaacagcatggtactggtaccaaaacagagatatagaccaatggaacagaacagagccctcataaataatgctgcatatctacaaccatgtgatctttgacaaacctgagaaaaacaagcaatggggaaaggattccctatttaataaatggtgccgggaaaactggctagccatatgtagaaagctgaaactggatcccttccttacacctcatacaaaaattaattcaagatgtattagagacttaaatgttagacctgaaaccataaaaaccctagaagaaaacctaggcagtaccattcaggacataggcatcggcaaggacttcatgtccaaaacaccaaaagcaatggcaacaaaagccaaaattgacaaatgggatctaattaaactaaggagcttctgcacagcaaaagaaactaccatcagagtgaacaggcaacctacagagtgggagaaaatttttgcaatctactcatctgacaaagggctaatatccagaatctacaatggactcaaacaaatttacaagaaaaaaacaaacaaccctatcaaaaaatgggtgaaggatatgaacagacacttttcaaaagaagacatttatgcagccaaaagacacatgaaaaaatgctcaccatcactggccatcagggaaatgcaaatcaaaaccataatgagatatcatctcacaccagttagaatggcaatcattaaaaagtcaggaaacaacaggtgctggagaggatatggagaaataggaacactttcacactgttggtgggactgtaaactagttcaaccgttgtggaaatcagtgtggcgattccttagggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccaacaaggatagactggattaagaaaatgtgtcacatatacaccatggaatactatgcagccataaaaaatgatgagttcatgtcctttgtagggacatggatgaagctggaaaccatcattctcagcaaactatagcaaggacaaaaaaacaaacaccacatgttctcactcataggtgggaattgaacaatgagaacacatggacacaggaaggggaacatcacacaccggggcctgttttgggtaggggtaggggggagggatagcattaggagatatacctaatgttaaatgacgagttaatgggtgcagcacaccaacatggcatatgtatacatatgtaactaacctgtaggttgtgcacatgtaccctaaaactaaagtataataaaaatatatataataataaaataaaaaaacaaatccaactttaaataaagggggtgttaaatgttaaaagaaaaaagagaatgaaacttatttttaaaatttgaacacaataggctattaatgaaactttatttaaatctttatatttttccaggccaattttaaagcttttaaaagttttgtttttttaattctgtgcccatttttagtaaatatagtatatttttcttaatggttcttaaggttttacatcataataatgcaaacatttctccaaatacttgatgtttagtatttccacgtcactgcatttagtgcattttcatgattttttaaatttccttgacatgttttgtatttccttgacatatataatattattaaaacacacactcaatcataatttaaatgctaatcctcacaaatctattagtctcaattttgtttaattggttttttttgtagtagatatataattttttatagtgaattacatcagtcttttctgtttacttcttttatactttgtaaggaattggataagtctcaaacaagacagttactcatcattctgggttttttgttttgttttgttttttgagacaaggtctcactctatcacccaggctggagtgcagaggcacaatcttgactcaccgcatccttgacctctctggctcaagtgatcctcccaccccagcctcttaagtagctgggaatacagtcacacaccaccacgcctggctgattttttgtatttttttgtagagacaggatttcctcatgttgcccatgctggtctcaaactcctgagctcaagcaatcttcctgctgtggccttgaaaactgctgggattacaagcaagtggcactgtgcccagcctctattctgttcttctttcatctgcatttatgtttaaaatttcaacttttaaaatttaatttttaaatgttgagaaataaaggacagtattttttcgtatagttattacctgaacatttattaaatgattatttagcataatgccatatgttctcattcttaatgtgtttgtaatctctcaattggttgcattttccatctgtcaaaaggtctcacttaaacattttaagctttgctgagtaccttttaaaaagtgtaaaaagggtgatacaccacaaatttcaccagaatttttaaagtatatattcctatttataattccaaatacaatttcggagttattttgagtttctaaaggatcttctttaaattttatatggaattttgatgatgtgataaaagtgaaaatacatatcttatagtactaaaaagtttatttggaaatacagtatgttctccactcatatccttcttccttaattactttatcaaattttgtgtttgtgttaccagttatgatatatttcttgtttaatattttttcttctaattttatatgcttttaaactattataagtgtactgattttattatactttctacccagttagtattttatattttctatttttgattctcttgaaacaaatgtgtcatatagatggagacactgaagaaaaaaataggaagattaggattagggaaaggttagggaaaaaaagtgtagttggtattttcttccataatcaatgagtgaaataaaattttctcaagcaatgactgcattgttacctcatcctcctccccaaacaaacattttaagctgaaatacagtgtgtctatactgcacttcaagaaatactttagctggattaatatctcaatggaatcggaattccatggaacataattatatcatttgactaaagtaaattcatagtcttttgttgcactgacttgtccttagtttagggttagttataaatactttcagaatatgttatgaatgactttaaataaattgataaagtaaagtcgcataaaacatcgtgatgtgttttaatctgtttgtgctgctttaacagaataccacagactaggtaatttataaggagcagaaatgtataggctcttagttctggaggctgggaactccaagatcaagcggccagcatttgattagagccttcttgctatgccataacatggcagaagtcatcacatggcagaaaggcaaacagtaggagagagagcaacaggagtcaaacttacaaccatgataatgataacagcattaatctattcatgagagccaggacctcatgactagccatcttttaaaagtcccttctcccaatactataaaaatggcaattaaatttcaacaagagttttggagaaaacaaacattcaaaccatagcatgattcaaacaaataaacagcaacaaaccgagaacaaatatataaatcctgattttaaatttaaaaatcaacaaaaggctaatgcataaaaataatcattgtaattccaaataaatacagattcaaatataaaataataacattaataataacatatttttaaaactgaatttaaaaataattaagaaaaataacacctaatgctgtaagggttttgttattcagtctctggaaaaaagtctaaaaaccttctggaaagcaatttggcttcacaaatataaaacctcaaataaatttatatattttgacttatcaataaaatctaccccatttctaggaaatgtattattaaaatatgataaaacgtttggataaagatgtgaagacactaatgtctggcacaacactatggaatgtttattttggatagatgcatagctacaataaaatattttgttctagtatgtaataaaaataaatttgaagtgggaaattttcatacatattgtatgtaaaaaagaaagaaaaaaaaaactatatgtgtgattgatctgaattgctcataatttcaaatgttatatattgatataacatttcatttttatcatgaagaaagatgcacatagatccactaaaatattaacagtctctagattttcagattctagatatttataaatcattttgatatacttattacatatcttatgaagactagagagtagagtacaccaactttgtgacatcatgtc
